US011337426B2

(12) United States Patent
Dagher et al.

(10) Patent No.: US 11,337,426 B2
(45) Date of Patent: May 24, 2022

(54) BIOLOGICAL CONTROL AGENTS AGAINST FIRE BLIGHT

(71) Applicant: Institut National De La Recherche Scientifique, Quebec (CA)

(72) Inventors: Fadi Dagher, Laval (CA); Eric Deziel, Rosemere (CA)

(73) Assignee: Institut National De La Recherche Scientifique, Quebec (CA)

( * ) Notice: Subject to any disclaimer, the term of this patent is extended or adjusted under 35 U.S.C. 154(b) by 1 day.

(21) Appl. No.: 16/706,514

(22) Filed: Dec. 6, 2019

(65) Prior Publication Data

US 2020/0178540 A1 Jun. 11, 2020

Related U.S. Application Data

(60) Provisional application No. 62/776,649, filed on Dec. 7, 2018.

(51) Int. Cl.

*A01N 63/20* (2020.01)
*C12N 1/20* (2006.01)
*A01N 63/22* (2020.01)
*A01N 63/27* (2020.01)

(52) U.S. Cl.

CPC ............. *A01N 63/20* (2020.01); *A01N 63/22* (2020.01); *A01N 63/27* (2020.01); *C12N 1/20* (2013.01)

(58) Field of Classification Search

None
See application file for complete search history.

(56) References Cited

U.S. PATENT DOCUMENTS

2010/0189798 A1 7/2010 Armstrong et al.
2018/0070586 A1* 3/2018 Kim ....................... A01N 25/22

FOREIGN PATENT DOCUMENTS

WO 2016/187703 A1 12/2016

OTHER PUBLICATIONS

Giddens et al. 2007 (Investigations into the in vitro antimicrobial activity and mode of action of the phenazine antibiotic D-alanylgriseoluteic acid; International Journal of Antimicrobial Agent 29: 93-97) (Year: 2007).*

Kim et al. 2012 (Controlled release of Pantoea agglomerans E325 for biocontrol of fire blight disease of apple; Journal of Controlled Release 161: 109-115). (Year: 2012).*

Giddens et al. 2002 (Characterization of a novel phenazine antibiotic gene cluster in Erwinia herbicola Eh1087; Mol Microbiol. 45(3) 769-783). (Year: 2002).*

BioSample: SAMN04990134; CFSAN: CFSAN034343, Pathogen: environmental/food/other sample from Paenibacillus polymyxa, 1 page [retrieved on Sep. 24, 2018 https://www.ncbi.nlm.nih.gov/biosample/?term=CFSAN034343].

BioSample: SAMN09909699; CFSAN: CFSAN047153, Pathogen: environmental/food/other sample from Pantoea agglomerans, 1 page [retrieved on Sep. 14, 2018 https://www.ncbi.nlm.nih.gov/biosample/9909699].

BioSample: SAMN09909698; CFSAN: CFSAN047154, Pathogen: environmental/food/other sample from Pantoea agglomerans, 1 page [retrieved on Sep. 14, 2018 https://www.ncbi.nlm.nih.gov/biosample/?term=CFSAN047154].

Fromin, N., et al., "The genotypic diversity of Pseudomonas brassicacearum populations isolated from roots of *Arabidopsis thaliana*: influence of plant genotype," FEMS Microbiology Ecology 37 21-29 (2001).

Granatstein, D., "Alternative Fire Blight Control Materials to Replace Antibiotics," Organic Tree Fruit Industry Work Group, 4 pages (2011).

Henry, D. A., et al., "Identification of Burkholderia cepacia Isolates from Patients with Cystic Fibrosis and Use of a Simple New Selective Medium," Journal of Clinical Microbiology, vol. 35, No. 3, p. 614-619 (1997).

Kim, In-Yong, et al., "Controlled release of Pantoea agglomerans E325 for biocontrol of fire blight disease of apple," Journal of Controlled Release 161, pp. 109-115 (2012).

Lenth, R. V., "Least-Squares Means: The R Package lsmeans," Journal of Statistical Software,, vol. 69, Issue 1 (2016).

Mitchell, R. E., et al., "An antibacterial pyrazole derivative from Burkholderia glumae, a bacterial pathogen of rice," Phytochemistry. vol. 69(15):2704-7 (2008).

Porter, J. N., et al., "Method for the Preferential Isolation of Actinomycetes from Soils," Biochemical Research Section, Lederle Laboratories, American Cyanamid Company, Pearl River, New York (1959).

Pusey, P. L., et al., "Antibiosis Activity of Pantoea agglomerans Biocontrol Strain E325 Against Erwinia amylovora on Apple Flower Stigmas," Phytopathology, vol. 101, No. 10, 1234-1241 (2011).

Roberts, D.C., et al., "Potential biological control of Erwinia tracheiphila by internal alimentary canal interactions in Acalymma vittatum with Pseudomonas fluorescens," Journal of Applied Microbiology ISSN 1364-5072 (2018).

Smits, T. H. M., et al., "Metabolic Versatility and Antibacterial Metabolite Biosynthesis Are Distinguishing Genomic Features of the Fire Blight Antagonist Pantoea vagans C9-1," Metabolism and Antibiotics of P. vagans 09-1,vol. 6 (7) e22247 (2011).

Stockwell, V. O., et al., "Control of Fire Blight by Pseudomonas fluorescens A506 and Pantoea vagans C9-1 Applied as Single Strains and Mixed Inocula," Phytopathology, vol. 100, No. 12, pp. 1331-1339 (2010).

(Continued)

*Primary Examiner* — Mary Maille Lyons
(74) *Attorney, Agent, or Firm* — Hamilton, Brook, Smith & Reynolds, P.C.

(57) ABSTRACT

Described herein are biopesticides having activity against *Erwinia* species, particularly against the fire blight phytopathogen *Erwinia amylovora*. The biopesticides comprise intact or vegetative cells, endospores, spores, and/or metabolites from one or more bacterial species or strains as active ingredients, wherein the vegetative cells, endospores, spores, and/or metabolites exhibit antimicrobial activity against phytopathogenic *Erwinia* species or *Erwinia amylovora*.

11 Claims, 8 Drawing Sheets

Specification includes a Sequence Listing.

(56) References Cited

OTHER PUBLICATIONS

Vrancken, K., "Pathogenicity and infection strategies of the fire blight pathogen Erwinia amylovora in Rosaceae: State of the art," Microbiology 159, pp. 823-832 (2013).
Wright et al.,"Pantoea agglomerans Strain EH318 Produces Two Antibiotics That Inhibit Erwinia amylovora In Vitro," Applied And Environmental Microbiology, vol. 67, No. 1, Jan. 2001. p. 284-292.
Stockwell et al., "Antibiosis Contributes to Biological Control of Fire Blight by Pantoea agglomerans Strain Eh252 in Orchards," Phytopathology, vol. 92, No. 11, 2002 p. 1202-1209.
Vanneste et al., "Presence of Genes Homologous to those Necessary for Synthesis of Microcin MccEh252 in Strains of Pantoea agglomerans," Proc. Xlth IW on Fire Blight, Eds.: K.B. Johnson and V.O. Stockwell, Acta Hort. 793, ISHS 2008, 6 pages.

* cited by examiner

Control (water only)

Inoculated (no treatment)

Inoculated + TSB

*P. agglomerans* NY60 only

Inoculated + *P. agglomerans* NY60

Streptomycin only

Inoculated + Streptomycin

Control (water only)

Inoculated (no treatment)

Inoculated + TSB

*P. agglomerans* NY60 only

Inoculated + *P. agglomerans* NY60

Streptomycin only

Inoculated + Streptomycin

BIOLOGICAL CONTROL AGENTS AGAINST FIRE BLIGHT

RELATED APPLICATION(S)

This application claims the benefit of U.S. Provisional Application No. 62/776,649, filed on Dec. 7, 2018. The entire teachings of the above application(s) are incorporated herein by reference.

The present invention relates to biological control agents having anti-microbial activity against the fire blight phytopathogen *Erwinia amylovora.*

The *Pantoea agglomerans* NY60 strain was deposited under accession number 190122-01 on Jan. 19, 2022 at International Depository Authority of Canada (IDAC) (National Microbiology Laboratory of Canada, 1015 Arlington Street, Winnipeg, Manitoba, Canada, R3E 3R2).

INCORPORATION BY REFERENCE OF MATERIAL IN ASCII TEXT FILE

This application incorporates by reference the Sequence Listing contained in the following ASCII text file being submitted concurrently herewith:

a) File name: 55911001000_Substitute_Sequence_Listing_02132020; created Feb. 14, 2020; 26,513 KB in size.

| SEQ ID NO: | Description |
|---|---|
| 1 | rpoB-f primer |
| 2 | rpoB-r primer |
| 3 | rpoB1698f primer |
| 4 | rpoB2041r primer |
| 5 | gyrA-f primer |
| 6 | gyrA-r primer |
| 7 | UP-1 primer |
| 8 | UP-2r primer |
| 9 | UP-1S primer |
| 10 | UP-2Sr primer |
| 11 | T7 primer |
| 12 | pA-27f-YM primer |
| 13 | pH primer |
| 14 | *P. agglomerans* NY60 chromosome |
| 15-18 | *P. agglomerans* NY60 plasmids 1-4 |
| 19 | *P. agglomerans* NY130 chromosome |
| 20-23 | *P. agglomerans* NY130 plasmids 1-4 |
| 24-103 | *P. poae* FL10F contigs 1-80 |
| 104-173 | *B. velezensis* FL50S contigs 1-70 |
| 174 | Tn-seq primer 1 |
| 175 | Tn-seq primer 2 |
| 176 | Tn-seq primer 3 |

The present application includes as part of its description a sequence listing that includes 176 sequences and this sequence listing is incorporated into the present application in its entirety.

BACKGROUND

Fire blight is a contagious disease affecting a number of agriculturally important crops such as apples, pears, and some other members of the Rosaceae family, and annual losses due to fire blight are significant in many countries. The bacterial plant pathogen responsible for fire blight is *Erwinia amylovora*, a rod-shaped Gram-negative bacterium capable of infecting different hosts in the Rosaceae family, including all species of the Maloideae subfamily.

While the most widely used formulations to control bacterial phytopathogens in crop protection are copper-based (e.g., copper hydroxide and copper sulphate), these formulations are not suitable for all plants because of phytotoxic effects, such as unacceptable rusting of the fruits of certain apple cultivars, and decreased fruit yields. Thus, the large-scale application of antibiotics (e.g., streptomycin and oxytetracycline) in agricultural fields have been widely used by growers to fight bacterial diseases, which has contributed to the rise of antibiotic resistant bacteria. In fact, antibiotics sprayed on apple and pear orchards were banned in some European countries to not only reduce the development of resistant bacteria, but also to eliminate the traces of antibiotics contaminating foods.

Presently, there are few effective biological products available to growers to fight diseases such as fire blight. Furthermore, some of the few biological products available were extensively tested as substitutes for antibiotics for more than 7 years in different regions of the United States, and they have generally been shown to have low efficacy and variability in results from one geography to another and from one year to the next (Granatstein, 2011). Thus, there is a need for effective and ecologically responsible products for controlling bacterial phytopathogens that cause fire blight and other plant diseases.

SUMMARY

Described herein are biopesticides having activity against *Erwinia* species, particularly *Erwinia amylovora*, the phytopathogen responsible for fire blight.

About 5,000 individual bacterial isolates from a total of 79 different North American environmental samples from a variety of geographic locations were collected, cultured and screened for potential direct antagonistic activity against *Erwinia amylovora*, based on their ability to produce inhibition zones on a lawn of *E. amylovora* 5435. Of the thousands of isolates screened, 205 candidate isolates were identified as exhibiting some degree of inhibition and cell-free supernatants from these 205 isolates were subsequently screened for potential activity of their extracellular metabolites. These screening efforts revealed a plurality of isolates whose undiluted cell-free supernatants exhibited anti-*Erwinia amylovora* activity, with cell-free supernatants from several isolates exhibiting activity even after 10-fold dilution. In fact, cell-free supernatants from several isolates even showed activity against streptomycin-resistant *E. amylovora*. Interestingly, the cell-free supernatants from several *Pantoea agglomerans* strains identified after initial screenings did not exhibit any detectable anti-*Erwinia amylovora* activity, but viable cells of these isolates exhibited potent anti-*Erwinia amylovora* activity, which in some cases were comparable to streptomycin treatment following in planta experiments on apple trees with minimal or no phytotoxicity observed. The identity of each of the active isolates was identified through DNA sequencing and other high-resolution taxonomic assignment methods/tools. Formulations of biopesticides comprising the active ingredients from the bacterial species/stains described herein were prepared having increased stability and/or shelf-life. Finally, the efficacy of selected biopesticides described herein were validated in field trials performed on McIntosh and Rome apple trees inoculated with *E. amylovora*, and compared to streptomycin treatment.

In some aspects, described herein is a biopesticide comprising intact or vegetative cells, endospores, spores, and/or metabolites from one or more bacterial species as active ingredients, wherein the vegetative cells, endospores, spores, and/or metabolites exhibit antimicrobial activity against phytopathogenic *Erwinia* species or *Erwinia amylovora*. In some embodiments, the one or more bacterial species may comprise spore-forming bacterial species, and/or the metabolites may comprise secondary and/or extracellular metabolites. In some embodiments, the one or more bacterial species may comprise or consist of: (a) a *Bacillus* species, a *Paenibacillus* species, a *Pantoea* species, a *Pseudomonas* species, or any combination thereof; (b) *Bacillus velezensis* (formerly known as *Bacillus amyloliquefaciens*), *Bacillus velezensis* subsp. *plantarum, Bacillus subtilis, Paenibacillus polymyxa, Pantoea agglomerans, Pseudomonas fluorescens, Pseudomonas poae*, or any combination thereof; (c) *Bacillus velezensis* 304, *Bacillus velezensis* 417, *Bacillus velezensis* 431, *Bacillus velezensis* subsp. *plantarum* FL50S, *Bacillus* sp. 331, *Bacillus* sp. 418, *Bacillus* sp. FD308, *Bacillus* sp. FD402, *Bacillus* sp. FD604, *Bacillus* sp. IRDA27, *Bacillus* sp. IRDA618, *Bacillus* sp. IRDA619, *Bacillus* sp. IRDA627, *Bacillus* sp. IRDA63, *Bacillus* sp. IRDA672, *Bacillus* sp. IRDA675, *Bacillus* sp. IRDA683, *Bacillus* sp. IRDA684, *Bacillus* sp. IRDA685, *Bacillus* sp. IRDA687, *Bacillus subtilis* 421, *Paenibacillus polymyxa* 273, *Paenibacillus polymyxa* 344, *Pantoea agglomerans* IRDA36, *Pantoea agglomerans* IRDA59, *Pantoea agglomerans* NY130, *Pantoea agglomerans* NY50, *Pantoea agglomerans* NY60, *Pseudomonas fluorescens* IRDA4, *Pseudomonas poae* FL10F, *Pseudomonas poae* FL3F, *Pseudomonas poae* FL4F, *Pseudomonas poae* FL9F, *Pseudomonas* sp. 41, *Pseudomonas* sp. 42, *Pseudomonas* sp. 43, *Pseudomonas* sp. NY1238, or any combination thereof; (d) *Pseudomonas poae, Bacillus velezensis* subsp. *plantarum, Paenibacillus polymyxa*, or any combination thereof; (e) *Pseudomonas poae* FL10F, *Pseudomonas poae* FL4F, *Pseudomonas poae* FL3F, *Bacillus velezensis* subsp. *plantarum* FL50S, *Paenibacillus polymyxa* 273, *Pseudomonas poae* FL9F, or any combination thereof; or (f) *Pantoea agglomerans* NY60 or *Pantoea agglomerans* NY130. In some embodiments, the one or more bacterial species comprise or consist of: (g) *Paenibacillus polymyxa, Bacillus velezensis* subsp. *plantarum, Pseudomonas poae, Pantoea agglomerans, Pantoea agglomerans, Pseudomonas fluorescens, Pseudomonas poae, Paenibacillus polymyxa, Bacillus velezensis* subsp. *plantarum*, or any combination thereof; and/or (h) *Paenibacillus polymyxa* 273, *Bacillus velezensis* subsp. *plantarum* FL50S, *Pseudomonas poae* FL10F, *Pantoea agglomerans* NY60, *Pantoea agglomerans* NY130, *Pseudomonas fluorescens* IRDA4, or any combination thereof.

In some embodiments, the biopesticide may comprise or consist of: (a) vegetative bacteria; (b) killed vegetative bacteria; (c) heat-killed vegetative bacteria; (d) sporulated bacteria; (e) bacterial spores or endospores; (f) bacterial extracellular metabolites; or (g) any combination thereof, from the one or more bacterial species as defined herein.

In some aspects, described herein is the use of the biopesticide as defined herein as an anti-microbial agent against a plant and/or human pathogenic microorganism, a phytopathogenic *Erwinia* species, *Erwinia amylovora*, or for the prevention and/or treatment of fire blight on a growing plant (e.g., a fruit plant, nut, cereal, vegetable, or flower).

In some aspects, described herein is a method for controlling the growth of a pathogenic microorganism on a target plant or tissue, the method comprising contacting the target plant or tissue with the biopesticide as defined herein.

In some aspects, described herein is a kit for preparing an aqueous solution for use in controlling a pathogenic microorganism (e.g. a phytopathogenic *Erwinia* species or *Erwinia amylovora*) on a plant tissue of a growing plant, the kit comprising: (a) the biopesticide as defined herein; and (b) a suitable container.

In some aspects, described herein is a method for producing the biopesticide as defined herein, the method comprising: for a biopesticide comprising spore-forming bacteria without vegetative cells as active ingredients, culturing vegetative cells from the one or more bacterial species in a sporulation medium for inducing sporulation; inactivating, heat-inactivating, or removing vegetative bacteria from the culture; or for a biopesticide comprising vegetative cells as active ingredients, culturing vegetative cells from the one or more bacterial species in a growth-promoting medium; and formulating the culture to improve viability.

In some aspects, described herein is a biopesticide comprising a vegetative *Pantoea agglomerans* strain as an active ingredient, wherein the vegetative *Pantoea agglomerans* strain: (a) is from the same subspecies as closely related *Pantoea agglomerans* strains NY60 (CFSAN047153) and NY130 (CFSAN047154); (b) has at least 90%, 91%, 92%, 93%, 94%, 95%, 96%, 97%, 98%, 99%, 99.5%, or 100% overall sequence identity at the genomic DNA level to CFSAN047153 and/or corresponding to the chromosomal sequence as set forth in SEQ ID NO: 14 and plasmids thereof (SEQ ID NOs: 15-18); and/or to CFSAN047154 and/or corresponding to the chromosomal sequence as set forth in SEQ ID NO: 19 and plasmids thereof (SEQ ID NOs: 20-23); (c) comprises genes encoding a bacteriocin, an aryl polyene, an acyl-homoserine lactone (hserlactone), a turnerbactin, a carotenoid, desferrioxamine B, a phenazine (e.g., pyocyanine and/or D-alanylgriseoluteic acid (AGA)), and a microcin; and/or (d) completely kills *E. amylovora* strains 5435, streptomycin-resistant 5153, and/or streptomycin-resistant S1605, when co-cultivated together in vitro.

In some aspects, described herein is a biopesticide comprising a live *Pseudomonas poae* strain and/or cell-free supernatant therefrom, as active ingredient, wherein the cell-free supernatant exhibits anti-*Erwinia amylovora* activity upon 10-fold dilution. In some embodiments, the *Pseudomonas poae* strain: (a) is from the same subspecies as *Pseudomonas poae* strain FL10F (CFSAN034337); (b) has at least 90%, 91%, 92%, 93%, 94%, 95%, 96%, 97%, 98%, 99%, 99.5%, or 100% overall sequence identity at the genomic DNA level to CFSAN034337 and/or corresponding to the contig sequences as set forth in any one of SEQ ID NOs: 24-103 or any combination thereof; and/or (c) comprises genes encoding a bacteriocin, an aryl polyene, a safracin, a pyoverdine, a mangotoxin, a poaeamide, a pyochelin, or any combination thereof.

In some aspects, described herein is a biopesticide comprising a live *Bacillus velezensis* strain and/or cell-free supernatant therefrom, as active ingredient, wherein the cell-free supernatant exhibits anti-*Erwinia amylovora* activity upon 10-fold dilution. In some embodiments, the *Bacillus velezensis* strain: (a) is from the same subspecies as *Bacillus velezensis* strain FL50SF (CFSAN034340); (b) has at least 90%, 91%, 92%, 93%, 94%, 95%, 96%, 97%, 98%, 99%, 99.5%, or 100% overall sequence identity at the genomic DNA level to CFSAN034340 and/or corresponding to contig sequences as set forth in any one of SEQ ID NOs: 104-173 or any combination thereof; and/or (c) comprises genes encoding difficidin, oxydifficidin, a bacteriocin, an aryl polyene, a macrolactin, a bacillaene, an iturin, a bacilysin, a surfactin, a bacillibactin, a fengycin, a plipastatin, a teichuronic acid, a locillomycin, a citrulline, or any combination thereof.

In some aspects, described herein is a method for manufacturing a biopesticide against fire blight, the method comprising: cultivating a bacterial strain which is the *Pantoea agglomerans* strain as defined herein, the *Pseudomonas poae* strain as defined herein, or the *Bacillus velezensis* strain as defined herein, under growth conditions; isolating active ingredients from the culture, the active ingredients comprising or consisting of intact or vegetative cells, endospores, spores, and/or metabolites from the bacterial species; and formulating the active ingredients for increased shelf-life, as compared to corresponding unformulated active ingredients.

General Definitions

The use of the word "a" or "an" when used in conjunction with the term "comprising" in the claims and/or the specification may mean "one" but it is also consistent with the meaning of "one or more", "at least one", and "one or more than one".

As used herein, the term "metabolites" refers to any compound, substance, or by-product obtainable by the culture or fermentation of a microorganism as described herein. In some embodiments, the metabolites of the present description may be produced by culturing microorganisms and harvesting extracellular metabolites produced therefrom (e.g., released into the culture supernatants). In other embodiments, the metabolites of the present description may be produced using recombinant DNA technology (e.g., recombinant proteins). In some embodiments, the metabolite may be a proteinaceous substance (i.e., a substance comprising a linear polymer chain of at least 3 amino acids bonded together by peptide bonds), bacteriocins, lantibiotics, lipopeptides and/or polyketides. In some embodiments, the metabolites may be extracellular bacterial and/or extracellular fungal secondary metabolites. As used herein, "secondary metabolites" refers to compounds that are not directly involved in normal growth, development, or reproduction. Unlike primary metabolites, the absence of secondary metabolites does not result in immediate death, but rather in long-term impairment of survivability, fecundity or aesthetics.

As used herein, the expression "antimicrobial" refers to the ability of the metabolites of the present description to prevent, inhibit, and/or destroy the growth of pathogenic microbes such as pathogenic bacteria and/or pathogenic fungi. In some embodiments, the expression "antimicrobial" encompasses agents or compounds exhibiting antagonistic activity against pathogenic microbes. In some embodiments, the antimicrobial activity may be in vitro antimicrobial activity or in vivo antimicrobial activity.

In some embodiments, the present description relates to metabolites having antimicrobial activity against phytopathogenic *Erwinia* species, particularly *Erwinia amylovora*. As used herein, term "pathogen" or "pathogenic" refers to an organism capable of producing a disease in a plant or animal. The term "phytopathogen" as used herein refers to a pathogenic organism that infects a plant.

In some embodiments, the present description relates to metabolites which may be extracellular bacterial metabolites. As used herein, the term "extracellular" refers to the compounds that are secreted or released (either actively or passively) into the extracellular medium upon culture of viable cells, but may also include compounds that contact the extracellular medium, but which remain associated with the cell membrane.

In some embodiments, the present description relates to metabolites from a *Bacillus* species, a *Paenibacillus* species, a *Pantoea* species, a *Pseudomonas* species, or any combination thereof. As used herein, the expression "from a [genus] species" or "obtainable from a [genus] species", refers to a compound that may be obtained (i.e., that is obtainable) from the culture or fermentation of a species belonging to the recited genus, but does not necessarily mean that the metabolite must be obtained from that particular species or from the culture of a microorganism per se. For example, compounds produced recombinantly or synthetically, but which have a structure substantially corresponding to the metabolite from the recited species, are also encompassed in the aforementioned expressions. In contrast, as used herein, the expression "produced from" is intended to refer to a compound which is obtained from the culture or fermentation of a microorganism of the present description.

In some embodiments, the compositions described herein may be used as an anti-microbial (e.g., bactericidal and/or fungicidal) agent against a plant and/or human pathogenic microorganism, or for the manufacture of an anti-microbial agent for same. In some embodiments, the pathogenic microorganism may be a phytopathogenic *Erwinia* species, particularly *Erwinia amylovora*. In some embodiments, antimicrobial compositions, bacterial species/strains described herein may be used for biological control. As used herein, the expression "biological control" refers to the control of a pathogen or any other undesirable organism by the use of at least a second organism other than man. In some embodiments, the compositions defined herein may be a biopesticide or biological pesticide. As used herein, the expressions "biopesticide" and "biological pesticide" refer to non-naturally occurring commercial products that may include naturally occurring metabolites/microorganisms which are formulated to have anti-microbial activity when applied to plants. Such formulations increase the stability and/or concentrations of the metabolites/microorganisms to levels that are not found in nature, which enable them to be useful as plant pesticides.

BRIEF DESCRIPTION OF THE DRAWINGS

The foregoing will be apparent from the following more particular description of example embodiments, as illustrated in the accompanying drawings in which like reference characters refer to the same parts throughout the different views. The drawings are not necessarily to scale, emphasis instead being placed upon illustrating embodiments.

In the appended drawings:

FIG. 2A: One milliliter sterile water (no inoculation). FIG. 2B: One milliliter *E. amylovora* S1605 at $OD_{620}$=0.2. FIG. 2C: One milliliter *E. amylovora* S1605 at $OD_{620}$=0.2, followed by 1 mL of Tryptic Soy Broth (TSB) medium 30 min later. FIG. 2D: One milliliter *P. agglomer-*

*ans* NY60 ($OD_{620}$=0.2) only. FIG. 2E: One milliliter *E. amylovora* S1605 at $OD_{620}$=0.2, followed by 1 ml NY60 culture ($OD_{620}$=0.2) 30 min later. FIG. 2F: One milliliter sterile water containing 100 ppm streptomycin. FIG. 2G: One milliliter *E. amylovora* S1605 at $OD_{620}$=0.2, followed by 1 mL sterile water containing 100 ppm streptomycin 30 min later.

FIG. 3A: One milliliter sterile water (no inoculation). FIG. 3B: Apple leaves cut with sterile scissors inoculated with 1 mL *E. amylovora* S1605 ($OD_{620}$=0.2). FIG. 3C: Apple leaves cut with sterile scissors inoculated with 1 mL *E. amylovora* S1605 ($OD_{620}$=0.2) followed by 1 mL TSB 30 min later. FIG. 3D: Apples leaves treated with 1 mL strain *P. agglomerans* NY60 ($OD_{620}$=0.2). FIG. 3E: Apple leaves cut with sterile scissors inoculated with 1 ml *E. amylovora* S1605 ($OD_{620}$=0.2), then treated with 1 mL strain *P. agglomerans* NY60 ($OD_{620}$=0.2) 30 min later. FIG. 3F: Apple leaves injected with 1 mL sterile water containing 100 ppm streptomycin. FIG. 3G: Apple leaves cut with sterile scissors inoculated with 1 mL *E. amylovora* S1605 ($OD_{620}$=0.2) then treated with 1 mL sterile water containing 100 ppm streptomycin 30 min later.

FIG. 4A: surfactins detected in positive ionization mode. FIG. 4B: iturins detected in positive ionization mode. FIG. 4C: fengycins detected in positive ionization mode. In the case of fengycins, peaks correspond to the doubly charged ions.

DETAILED DESCRIPTION

Figure 1A:
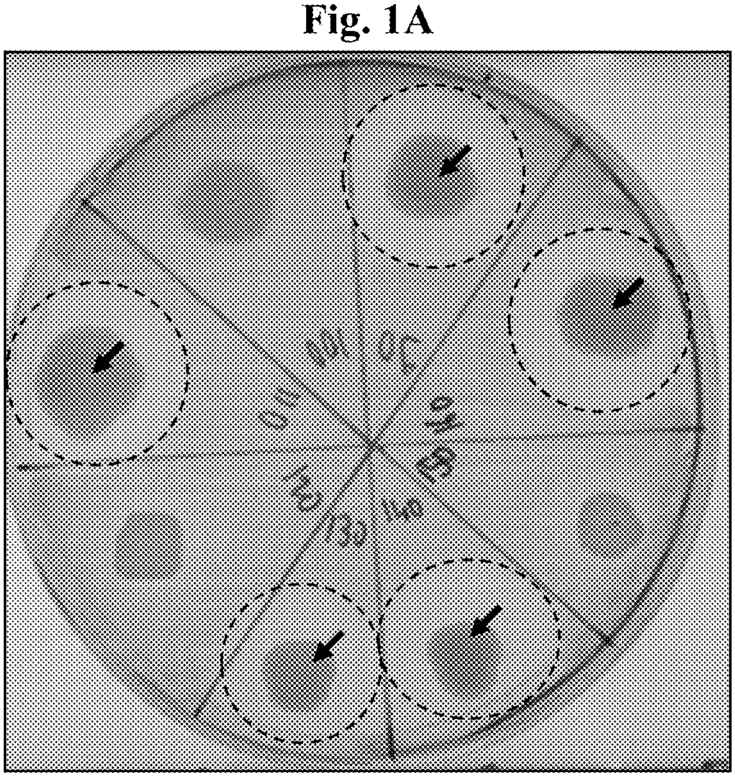
FIG. 1A shows the antagonistic activity of several active bacterial isolates against *E. amylovora* 5435. Bacterial isolates such as those indicated with arrows were selected because they formed clear haloes (inhibition zones indicated by dotted circles) around their colonies on an *E. amylovora* 5435 lawn.

In some aspects, described herein is a biopesticide comprising active ingredients from one or more bacterial species and/or strains that exhibit antimicrobial activity against phytopathogenic *Erwinia* species, particularly against *Erwinia amylovora*, the bacterial plant pathogen responsible for fire blight.

In some embodiments, the one or more bacterial species and/or strains described herein may comprise or consists of: (a) bacteria from the genus *Bacillus, Paenibacillus, Pantoea, Pseudomonas*, or any combination thereof; (b) bacteria from the species *Bacillus velezensis* (i.e. *Bacillus amyloliquefaciens*), *Bacillus velezensis* subsp. *plantarum, Bacillus subtilis, Paenibacillus polymyxa, Pantoea agglomerans, Pseudomonas fluorescens, Pseudomonas poae*, or any combination thereof; or (c) the bacterial strains *Bacillus velezensis* 304, *Bacillus velezensis* 417, *Bacillus velezensis* 431, *Bacillus velezensis* subsp. *plantarum* FL50S, *Bacillus* sp. 331, *Bacillus* sp. 418, *Bacillus* sp. FD308, *Bacillus* sp. FD402, *Bacillus* sp. FD604, *Bacillus* sp. IRDA27, *Bacillus* sp. IRDA618, *Bacillus* sp. IRDA619, *Bacillus* sp. IRDA627, *Bacillus* sp. IRDA63, *Bacillus* sp. IRDA672, *Bacillus* sp. IRDA675, *Bacillus* sp. IRDA683, *Bacillus* sp. IRDA684, *Bacillus* sp. IRDA685, *Bacillus* sp. IRDA687, *Bacillus subtilis* 421, *Paenibacillus polymyxa* 273 (also referred to as *Paenibacillus peoriae* 273), *Paenibacillus polymyxa* 344, *Pantoea agglomerans* IRDA36, *Pantoea agglomerans* IRDA59, *Pantoea agglomerans* NY130, *Pantoea agglomerans* NY50, *Pantoea agglomerans* NY60, *Pseudomonas fluorescens* IRDA4, *Pseudomonas poae* FL10F, *Pseudomonas poae* FL3F, *Pseudomonas poae* FL4F, *Pseudomonas poae* FL9F, *Pseudomonas* sp. 41, *Pseudomonas* sp. 42, *Pseudomonas* sp. 43, *Pseudomonas* sp. NY1238, or any combination thereof. Bacteria from the above-mentioned genera/species/strains were found to produce inhibition zones on a lawn on *E. amylovora* after screenings for antimicrobial activity of cell-free supernatants (see Tables 3 and 4) and/or direct antagonistic activity (see Table 5), as described in Example 2.

In some embodiments, the one or more bacterial species and/or strains described herein may comprise or consists of: (d) bacteria from the species *Pseudomonas poae, Bacillus velezensis* subsp. *plantarum, Paenibacillus polymyxa*, or any combination thereof; or (e) bacteria from the strains *Pseudomonas poae* FL10F, *Pseudomonas poae* FL4F, *Pseudomonas poae* FL3F, *Bacillus velezensis* subsp. *plantarum* FL50S, *Paenibacillus polymyxa* 273, *Pseudomonas poae* FL9F, or any combination thereof. Cell-free supernatants from the above-mentioned species/strains were found to produce inhibition zones on a lawn on *E. amylovora* even following a 10-fold dilution, as shown in Table 3.

In some embodiments, the one or more bacterial species and/or strains described herein may comprise or consists of: (f) bacteria from the strains *Pantoea agglomerans* NY60 or *Pantoea agglomerans* NY130. Strikingly, these strains were the only ones that exhibited the ability of completely killing *E. amylovora* strains S435, streptomycin-resistant S153, and streptomycin-resistant S1605 when co-cultivated together in vitro, as described in Examples 1.8 and 5. Such effective inhibitory activity of *P. agglomerans* against *E. amylovora* is not believed to have been previously reported (Pusey et al., 2011; Smits et al., 2011; Stockwell et al., 2010; Kim et al., 2012), and is particularly unexpected because, for example, of the inactivity of their extracellular metabolites against *E. amylovora* (see Table 3).

In some embodiments, the one or more bacterial species and/or strains described herein may comprise or consists of: (g) bacteria from *Paenibacillus polymyxa, Bacillus velezensis* subsp. *plantarum, Pseudomonas poae, Pantoea agglomerans, Pantoea agglomerans, Pseudomonas fluorescens, Pseudomonas poae, Paenibacillus polymyxa, Bacillus velezensis* subsp. *plantarum*, or any combination thereof; and/or (h) bacteria from the strains *Paenibacillus polymyxa* 273, *Bacillus velezensis* subsp. *plantarum* FL50S, *Pseudomonas poae* FL10F, *Pantoea agglomerans* NY60, *Pantoea agglomerans* NY130, *Pseudomonas fluorescens* IRDA4, or any combination thereof. These species/strains were shown to be amendable to formulation for improved shelf-life, as described in Example 6. Furthermore, the cell-free supernatants from *Pseudomonas poae* FL10F, *Paenibacillus polymyxa* 273, *Bacillus velezensis* subsp. *plantarum FL50S*, *Pseudomonas*, demonstrated the strongest antimicrobial activity against three different *E. amylovora* strains, including two streptomycin-resistant strains.

In some embodiments, one or more bacterial species and/or strains described herein may comprise or consists of the following strains: *Paenibacillus polymyxa* 273, which is the strain corresponding to the Center for Food Safety and Applied Nutrition (CF SAN) strain CFSAN034343, BioSample: SAMN04990134, GenBank assembly accession: GCA_001707685.1, Genbank assembly name: ASM170768v1, GenBank sequence accession no: NZ_LYND01000206; *Pseudomonas* pose FL10F, which is the strain corresponding to CFSAN strain CFSAN034337 and/or corresponding to the contig sequences as set forth in any one of SEQ ID NOs: 24-103 or any combination thereof; *Pseudomonas* pose FL9F, which is the strain corresponding to CF SAN strain CFSAN055119; *Pseudomonas* pose FL3F, which is the strain corresponding to CF SAN strain CFSAN034336; Fluorescent *Pseudomonas* spp. IRDA4, which is the strain corresponding to CF SAN strain CFSAN055120; *Bacillus velezensis* FL50S which is the strain corresponding to CFSAN strain CFSAN034340 and/or corresponding to contig sequences as set forth in any one of SEQ ID NOs: 104-173 or any combination thereof; *Pantoea agglomerans* NY60, which is the strain corresponding to CFSAN strain CFSAN047153, BioSample: SAMN09909699 and/or corresponding to the chromosomal sequence as set forth in SEQ ID NO: 14 and plasmids thereof (SEQ ID NOs: 15-18); or *Pantoea agglomerans* NY130, which is the strain corresponding to CFSAN strain CFSAN047154, BioSample: SAMN09909698 and/or corresponding to the chromosomal sequence as set forth in SEQ ID NO: 19 and plasmids thereof (SEQ ID NOs: 20-23). In some embodiments, the one or more bacterial species and/or strains described herein may comprise or consists of a strain (e.g. a subspecies) having at least 90%, 91%, 92%, 93%, 94%, 95%, 96%, 97%, 98%, 99%, 99.5%, or 100% overall sequence identity at the genomic DNA level to one of the strains identified herein by a public CF SAN strain number and/or GenBank accession number.

In some embodiments, a *Pseudomonas poae* strain described herein may comprise native genomic and/or recombinantly-introduced genes encoding one or more of the metabolites a bacteriocin, an aryl polyene, a safracin, a pyoverdine, a mangotoxin, a poaeamide, a pyochelin, and a tolaasin; preferably a bacteriocin, an aryl polyene, a safracin, a pyoverdine, a mangotoxin, a poaeamide, a pyochelin, or any combination thereof.

In some embodiments, a Fluorescent *Pseudomonas* spp. strain described herein may comprise native genomic and/or recombinantly-introduced genes encoding one or more of the metabolites a bacteriocin, an aryl polyene, a safracin, a pyoverdine, a mangotoxin, a poaeamide, a pyochelin, a syringafactin, or any combination thereof.

In some embodiments, a *Pantoea agglomerans* strain described herein may comprise native genomic and/or recombinantly-introduced genes encoding one or more of the metabolites a bacteriocin, an aryl polyenes, an acyl homoserine lactone, a turnerbactin, a carotenoid, desferrioxamine B, a phenazine (e.g., pyocyanine and/or D-alanylgriseoluteic acid (AGA)), a microcin, or any combination thereof.

In some embodiments, a *Bacillus velezensis* strain herein may comprise native genomic and/or recombinantly-introduced genes encoding one or more proteins involved in the synthesis, upregulation, or extra-cellular export of difficidin, oxydifficidin, a bacteriocin, an aryl polyene, a macrolactin, a bacillaene, an iturin, a bacilysin, a surfactin, a bacillibactin, a fengycin, a plipastatin, a teichuronic acid, a locillomycin, a citrulline, or any combination thereof.

As used in the context of biopesticides described herein, the expression "active ingredient" refers mainly to bacteria-derived agents that are present in sufficient concentrations and formulated to possess the desired antimicrobial activity (e.g., against *Erwinia* species, particularly against *Erwinia amylovora*). In some embodiments, the active agents may include intact cells (e.g., live vegetative cells, sporulated bacteria), killed vegetative bacteria (e.g., heat-killed vegetative bacteria), bacterial endospores/spores (e.g., heat-treated endospores/spores), metabolites (e.g., primary, secondary, intracellular, extracellular/secreted metabolites), or any combination thereof, from one or more bacterial species or strains described herein that exhibit antimicrobial activity against *Erwinia amylovora*. In some embodiments, the active ingredients are obtainable from or produced by a bacterial species/strain described herein.

In some embodiments, the biopesticide described herein may comprise active agents from one or more spore-forming bacterial species described herein (e.g., *P. polymyxa, B. velezensis* subsp. *plantarum*). For example, the biopesticide may be prepared as described in Example 1.11 by culturing the spore-forming bacteria in a sporulation medium (e.g., Schaeffer's sporulation medium) under conditions (e.g., temperature, time, and agitation conditions) to achieve the desired level of sporulation. The cultures may then be heated at a temperature and for a sufficient period of time to inactivate or kill substantially all vegetative bacteria in the culture, thereby producing a product devoid of vegetative bacteria that comprises spores and/or metabolites (e.g., extracellular metabolites) as active ingredients. In some embodiments, biopesticides lacking live, vegetative bacteria may present advantages in terms of product storage, shelf-life, as well as more favorable paths for regulatory approval.

In some embodiments, the biopesticides described herein may comprise live vegetative bacteria from one or more bacterial species/strains described herein as an active ingredient. Such biopesticide formulations may be advantageous particularly for bacterial species/strains that exhibit their antimicrobial activity via direct antagonism and/or competition (e.g., as shown in Table 5 for various *Pantoea agglomerans* strains such as NY50, NY60, NY130, IRDA36, and IRDA59; and in Example 5), and/or bacteria that produce/secrete antimicrobial extracellular metabolites. Such vegetative bacteria-containing biopesticide formulations may also be advantageous to achieve, for example, longer-lasting products that can colonize, compete with *E. amylovora*, and/or provide extended protection to target plants susceptible to fire blight or other diseases. Indeed, candidate bacteria in the present study were isolated from the flowers, leaves, and soil in apple- and pear orchards from springtime bloom to the summer season. In this way, the likelihood of isolating bacteria capable of colonizing the trees and competing against *E. amylovora* would be optimized.

In some embodiments, the biopesticides described herein may comprise live vegetative bacteria from one or more bacterial species/strain described herein as an active ingredient, wherein the live vegetative bacteria have a functional type VI secretion system. Without being bound by theory, such systems may be mainly responsible for interbacterial antagonism (e.g., for *P. agglomerans*).

In some embodiments, the biopesticides described herein may comprise live vegetative bacteria from only one bacterial species/strain described herein (or in total) as an active ingredient. Such biopesticide formulations may be advantageous particularly for bacterial species/strains that show antagonism not only with *E. amylovora*, but also with other antimicrobial (e.g., anti-*Erwinia*) bacterial species/strains.

Furthermore, a biopesticide comprising only a single bacterial species/strain as an active ingredient may be easier and/or less costly to produce and formulate that biopesticides comprising combinations of different bacterial species/strains.

In some embodiments, preparation of such formulation may comprise a step of culturing the one or more bacterial species under conditions to promote or increase production of secondary metabolites and/or extracellular metabolites (e.g., as compared to under standard growth conditions). For example, the one or more bacterial species are cultured in the presence of glycerol (e.g., about 0.5% w/w) to promote production of extracellular metabolites. Accordingly, the biopesticides described herein may comprise glycerol.

In some embodiments, the cultures comprising live vegetative bacteria and their metabolites may be treated (e.g., heated) to kill remaining vegetative bacteria, leaving the metabolites as active ingredients. As mentioned above, biopesticides lacking live, vegetative bacteria may present advantages in terms of product storage, shelf-life, as well as more favorable paths for regulatory approval. In some embodiments, the intact or vegetative cells may be removed (e.g., via centrifugation and/or filtration) to obtain a cell-free product.

In some embodiments, the biopesticides described herein may comprise one or more agriculturally-suitable additives or preservatives for increased stability/shelf-life. For example, one or more agriculturally-suitable salts may be added as a preservative (e.g., NaCl at about 4% w/w).

In some embodiments, the biopesticides described herein may comprise more than one type of active ingredients (e.g., vegetative bacteria, sporulated bacteria, endospores/spores, and/or extracellular metabolites) and/or active ingredients originating from at least two, at least three, at least four, at least five, at least six, at least seven, at least eight, at least nine, or at least ten different bacterial species/strains described herein. In some embodiments, the combination use of different types of active ingredients and/or from different bacterial species may reduce the likelihood that the pathogenic microorganism (e.g., *E. amylovora*) develops resistance.

In some embodiments, the biopesticides described herein may lack (not comprise) vegetative bacteria as an active ingredient or is a cell-free composition; and may comprise bacterial spores or endospores, and/or bacterial extracellular metabolites from one or more bacterial species as defined herein, as active ingredients. Alternatively, in some embodiments, the biopesticides described herein may comprise vegetative bacteria (and extracellular metabolites) from the one or more bacterial species as defined herein, as active ingredients. In some embodiments, biopesticides described herein comprise vegetative *Pantoea agglomerans, Pantoea agglomerans* NY50, *Pantoea agglomerans* NY60, *Pantoea agglomerans* NY130, *Pantoea agglomerans* IRDA36, *Pantoea agglomerans* IRDA59, or any combination thereof, as active ingredients.

In some embodiments, the biopesticides described herein may comprise active ingredients (e.g., cells, spores, metabolites) from a microorganism that is naturally-occurring and/or that has not been genetically modified using recombinant DNA technology, and thus qualifies as a natural biopesticide and/or natural bioproduct. In alternative embodiments, the biopesticides described herein may comprise active ingredients (e.g., cells, spores, metabolites) from a microorganism that is or has been genetically modified using recombinant DNA technology, for example to improve efficacy and/or stability. In some embodiments, the active ingredients (e.g., cells, spores, metabolites) may be from a mutant microorganism derived from a bacterial species/strain described herein, wherein the mutant retains anti-*Erwinia amylovora* activity.

In some embodiments, the present description relates to genetically modified or mutant antimicrobial bacterial or fungal strains as defined herein. As used herein, the term "mutant" making reference to a microorganism refers to a modification of the parental strain in which the desired biological activity (e.g., ability to produce antimicrobial metabolites as defined herein) is similar to or higher than that expressed by the parental strain.

In some embodiments, the biopesticides described herein have the ability to completely kill *Erwinia amylovora* S453, *Erwinia amylovora* S153, *Erwinia amylovora* S1605, or any combination thereof, when co-cultured together in vitro (e.g., as described in Example 5).

In some embodiments, the biopesticides described herein may exhibit antimicrobial activity against a further plant and/or human pathogenic microorganism, or a pathogenic virus, bacteria, fungus, yeast, mold, or any combination thereof. In some embodiments, biopesticides described herein may have broad spectrum antimicrobial activity. In some embodiments, the biopesticides described herein may exhibit higher antimicrobial activity against *Erwinia* species (e.g., *Erwinia amylovora*), as compared to other phytopathogenic species.

In some embodiments, biopesticides described herein may comprise at least one, at least two, at least three, at least four, at least five, at least six, at least seven, at least eight, at least nine, or at least ten different bacterial metabolites (e.g., secondary metabolites and/or extracellular metabolites). In some embodiments, the metabolites may comprise lipopeptides and/or siderophores from the one or more bacterial species as defined herein. In some embodiments, the metabolites may comprise metabolites selected from non-ribosomal lipopeptides (NRPs), bananamide, poaeamide, poacin, viscosin, massetolide, orfamide, arthrofactin, surfactin, fengycin, plipastatin, iturin, bacilysin, bacillibactin, bacillomycin, locillomycin, paenilarvin, pelgipeptin, polymyxin, paenibacterin, fusaricidin, bacitracin, tridecaptin, bacteriocin, arylpolyene, acyl homoserine lactone (hserlactone), turnerbactin, carotenoid, desferrioxamine B, pyocyanine, microcin, pantocin, safracin, pyoverdine, mangotoxin, pyochelin, tolaasin, syringafactin, or any combination thereof.

In some embodiments, biopesticides described herein may comprise one or more polyketides. In some embodiments, polyketides could comprise difficidin and/or oxydifficidin. In some embodiments, said polyketides can be oxidized and/or dephosphorylated. In some embodiments, said polyketides may be from one or more bacterial species described herein. In some embodiments, said polyketides may be from *B. velezensis* FL50S.

In some embodiments, biopesticides described herein may comprise isolated, purified, or enriched oxydifficidin (e.g., as the major or principal against against phytopathogenic *Erwinia* species (e.g., *Erwinia amylovora*). In some embodiments, the levels of oxydifficidin in the biopesticides described herein may be present at levels or concentrations that do not occur in nature. In some embodiments, biopesticides described herein may comprise a fraction of cell-free supernatant comprising concentrated oxydifficidin, and optionally lower levels of difficidin. In some embodiments, a cell-free supernatant (or fraction thereof) comprising difficidin may be subjected to an oxidation reaction to convert the difficidin to oxydifficidin, thereby producing a composition comprising increased oxydifficidin. In some embodiments, the present description relating to oxydifficidin may comprise chemical variants of oxydifficidin (e.g., dephosphorylated oxydifficidin).

In some embodiments, biopesticides described herein may comprise one or more lipopeptides. In some embodiments, said lipopeptides could be cyclic lipopeptides. In some embodiments, biopesticides described herein may comprise one or more lipopeptides from the viscosin subfamily, such as white-line-inducing principle (WLIP), massetolide E, massetolide F, massetolide L, viscosin, or any combination thereof. In some embodiments, said cyclic lipopeptides comprise massetolide and/or viscosin. In some embodiments, said massetolide and/or viscosin is white line-inducing principle (WLIP). In some embodiments, said cyclic lipopeptides may be from one or more bacterial species described herein. In some embodiments, said cyclic lipopeptides may be from *P. poae* FL10F.

In some embodiments, biopesticides described herein may comprise one or more metabolites, antibiotics, or proteins involved in the synthesis and/or release of antibiotics. In some embodiments, the antibiotic is a phenazine. In some embodiments, the phenazine is D-alanylgriseoluteic acid (AGA). In some embodiments, said protein involved in the synthesis and/or release of antibiotics is the bacterial protein EhpJ. In some embodiments, said metabolites, antibiotics, or proteins may be from one or more bacterial species described herein. In some embodiments, said metabolites, antibiotics, or proteins may be from *P. agglomerans* NY60 or NY130.

In some embodiments, biopesticides described herein may comprise an agriculturally acceptable excipient, additive, and/or preservative (e.g., non-toxic carriers, surfactants, preservatives, nutrients, UV protectants, stickers, spreaders, and chelating agents). As used herein, the phrase "agriculturally acceptable excipient" refers to an essentially inert substance that can be used as a diluent and/or carrier for an active agent (e.g., antimicrobial metabolites of the present description) in a composition or biopesticide for treatment of plants.

In some embodiments, biopesticides described herein may be formulated as a liquid, concentrate, powder, tablet, gel, pellets, granules, or any combination thereof.

In some embodiments, biopesticides described herein, once applied to a target plant, may have no detectable phytotoxic effect on said target plant, or on the fruits, nuts, or leaves thereof.

In some embodiments, the biopesticides described herein comprise effective amounts of each active ingredient. An "effective amount", as used herein, is an amount sufficient to effect beneficial or desired results. An effective amount can be administered in one or more administrations. In terms of treatment, inhibition or protection, an effective amount is that amount sufficient to ameliorate, stabilize, reverse, slow or delay progression of the target infection or disease states.

In some embodiments, biopesticides described herein may comprise one or more active ingredients at concentrations of at least about 100 ppm, 200 ppm, 300 ppm, 400 ppm, 500 ppm, 600 ppm, 700 ppm, 800 ppm, 900 ppm, 1000 ppm, 1500 ppm, 2000 ppm, 2500 ppm, 3000 ppm, 3500 ppm, 4000 ppm, 4500 ppm, 5000 ppm, 5500 ppm, 6000 ppm, 6500 ppm, 7000 ppm, 8000 ppm, 8500 ppm, 9000 ppm, 9500 ppm, or 10 000 ppm. In some embodiments, biopesticides described herein may comprise one or active ingredients at concentrations of between about 100 ppm, 200 ppm, 300 ppm, 400 ppm, 500 ppm, 600 ppm, 700 ppm, 800 ppm, 900 ppm, 1000 ppm, 1500 ppm, 2000 ppm, 2500 ppm, 3000 ppm, 3500 ppm, 4000 ppm, 4500 ppm, 5000 ppm, to about 10 000 ppm. The term "about" is used herein to indicate that a value includes the standard deviation of error for the device or method being employed to determine the value. In general, the terminology "about" is meant to designate a possible variation of up to 10%. Therefore, a variation of 1, 2, 3, 4, 5, 6, 7, 8, 9 and 10% of a value is included in the term "about".

In some embodiments, biopesticides described herein are for use as an anti-microbial agent against a plant and/or human pathogenic microorganism, a phytopathogenic *Erwinia* species, *Erwinia amylovora*, or for the prevention and/or treatment of fire blight on a growing plant. In some embodiments, the present description relates to the use of the biopesticide as defined herein as an anti-microbial agent against a plant and/or human pathogenic microorganism, a phytopathogenic *Erwinia* species, *Erwinia amylovora*, or for the prevention and/or treatment of fire blight on a growing plant. In some embodiments, the growing plant is a fruit plant, nut, cereal, vegetable, or flower. In some embodiments, the fruit is pome fruit trees and related plants, Pear (*Pyrus* species), quince (*Cydonia*), apple, crabapple (*Malus* species), firethorns (*Pyracantha* species), hawthorn (*Crataegus* species), *Spiraea, Cotoneaster*, toyon (*Photinia* species), juneberry, serviceberry (*Amelanchier* species), loquat (*Eriobotria*), mountain ash (*Sorbus* species), blossom (*Prunus*) peach, apricot, cherry, banana, blackberry, blueberry, cantaloupe, cherry, cranberry, currant, grapes, greengage, gooseberry, honeydew, lemon, mandarin, melon, orange, peach, pears, pineapple, plum, raspberry, strawberry, tomatoes, watermelon, grapefruit, pepper, olive, or lime; the nut is: almond, beech nut, Brazil nut, butternut, cashew, chestnut, chinquapin, filbert, hickory nut, macadamia nut, pecan, walnut, or pistachio; the cereal is: amaranth, breadnut, barley, buckwheat, canola, corn, fonio, kamut, millet, oats, *quinoa*, cattail, chia, flax, kañiwa, pitseed goosefoot, wattleseed, rice, rye, sorghum, spelt, teff, triticale, wheat, or colza; the vegetable is: artichoke, bean, beetroot, broad bean, broccoli, cabbage, carrot, cauliflower, celery, chicory, chives, cress, cucumber, kale, dill, eggplant, kohlrabi, lettuce, onion, pepper, parsnip, parsley, pea, potato, pumpkin, radish, shallot, soybean, spinach, turnip, or peanut; or the growing plant is an apple tree, pear tree, an apricot plant, stone fruit tree, a plant from the rose family (Rosaceae family, or the Maloideae subfamily).

In some aspects, described herein is a method for controlling the growth of a pathogenic microorganism on a target plant or tissue, the method comprising contacting said target plant or tissue with the biopesticide as defined herein in sufficient/effective amounts to achieve the desired antimicrobial effect. In some embodiments, the pathogenic microorganism is a phytopathogenic *Erwinia* species or *Erwinia amylovora*. In some embodiments, the contacting method comprises spraying, irrigating, painting, daubing, and/or fogging, onto and/or into the target plant or tissue, the target plant or tissue's hydroponic substrate, and/or the target plant or tissue's agricultural earth (e.g., a growing plant as defined herein).

In some aspects, described herein is a kit for preparing an aqueous solution for use in controlling a pathogenic microorganism (e.g., a phytopathogenic *Erwinia* species or *Erwinia amylovora*) on a plant tissue of a growing plant, the kit comprising a biopesticide as defined herein; and a suitable container (e.g., a pouch, a tablet, or bucket).

In some aspects, described herein is a method for producing the biopesticide as defined herein. For a biopesticide comprising spore-forming bacteria without vegetative cells as active ingredients, the method may comprise culturing vegetative cells from the one or more bacterial species/strain described herein in a sporulation medium for inducing sporulation; and inactivating, heat-inactivating, or removing vegetative bacteria from the culture. For a biopesticide comprising vegetative cells as active ingredients, The method may comprise culturing vegetative cells from the one or more bacterial species/strain described herein in a growth-promoting medium; and formulating the culture to improve viability. In some embodiments, the aforementioned methods may further comprise culturing the one or more bacterial species/strains described herein under conditions to promote production of secondary metabolites and/or extracellular metabolites (e.g., in the presence of glycerol, such as about 0.5% w/w glycerol). In some embodiments, the method may further comprise adding a preservative, additive or stabilizer to improve the shelf-life of the active ingredients. In some embodiments, the method may comprise combining one or more active ingredients from at least two, at least three, at least four, at least five, at least six, at least seven, at least eight, at least nine, or at least ten different bacterial species/strains described herein.

EXAMPLES

Example 1: Materials and Methods 1.1 Media

Two nonselective media (Tryptic Soy Agar (TSA), and Plate Count Agar (PCA)) and three selective media (Benedict, for isolation of *Streptomyces* spp., Porter et al., 1960; BCSA, for isolation of *Burkholderia* spp., Henry et al., 1997); and Gould, for isolation of *Pseudomonas* spp., Fromin et al., 2001) supplemented with 50 mg/mL cycloheximide (to limit the growth of fungi) were used to isolate bacteria from environmental samples.

1.2 Isolation of Microorganisms from Plants

Ten seeds and three segments (0.5 $cm^2$) randomly excised from each leaf, stem, root, and fruit were vortexed in 5 mL sterile 0.85% (w/w) NaCl. To isolate sporulating bacteria, the suspensions were preheated at 80° C. for 30 min. Aliquots (100 μL) of each suspension were spread onto the nonselective- and selective media plates. To isolate bacteria, the plates were incubated in the dark for 2-5 days at room temperature (~21° C.). Microorganisms were isolated from plant samples in triplicate.

1.3 Isolation of Bacteria from Soil

One gram of soil was added to 9 mL sterile phosphate-buffered saline (PBS) then agitated for 30 min. Sample suspensions were serially diluted. One hundred microliters of each dilution ($10^{-2}$, $10^{-3}$, and $10^{-4}$) were spread onto nonselective- and selective media. Plates were incubated under the same conditions as above. This assay was performed in triplicate.

1.4 Storage and Culture of Isolated Bacteria

Colonies of bacteria were purified first and then colonies with different morphological characteristics were transferred to tubes containing 3 mL TSB and incubated overnight at 30° C. Bacteria were stored at −80° C. in TSB amended with 20% w/w glycerol.

1.5 Strains Used to Evaluate Antimicrobial Activity

The pathogen strains used as indicators for antimicrobial activity were *E. amylovora* S435 (IRDA, Quebec, Canada), streptomycin-resistant *E. amylovora* S153 (Botany and Plant Pathology, Oregon State University, USA), streptomycin-resistant *E. amylovora* S1605 (MAPAQ, Quebec, Canada).

1.6 First Screening Step: Antagonistic Activity Assays

The antagonistic activities of the bacterial isolates against *E. amylovora* were determined by an agar plate assay.

Method:

Aliquots of bacterial colonies were selected from each bacterial glycerol-frozen stock solution and incubated overnight at 30° C. in 3 mL TSB. Five microliters of each bacterial culture were deposited on lawns of *E. amylovora* 5435 growing on TSA plates. These lawns were first made by incubating 50 μL of *E. amylovora* S435 overnight in 3 mL TSB at 30° C. and then resuspending them in sterile water to get an $OD_{620}$ of 0.2. Finally, 100 μL of the suspensions were spread onto TSA plates. The plates were incubated at room temperature (~21° C.) for 2 d. Bacterial isolates forming clear haloes (inhibition zones; see FIG. 1A) on the *E. amylovora* S435 lawns were selected for the second screening step.

1.7 Second Screening Step: Antimicrobial Activity Assays

For evaluation of the extracellular antimicrobial activity, bacterial isolates produced clear inhibition zones in at least one of the previous assays were inoculated into 3 mL TSB at 30° C. and 150 rpm on a rotary shaker for 2 d. The cultures were then centrifuged at 18,000×g for 10 min at 20° C. and the supernatants were passed through a 0.22-μm pore diameter filter to obtain sterile supernatant.

Antimicrobial activity against *E. amylovora* S435 was assessed using a well-diffusion inhibition assay. First, lawns of the test bacteria were grown on agar plates. Fifty microliters of *E. amylovora* S435 were incubated overnight in 3 mL TSB at 30° C. and 150 rpm and then resuspended in sterile water ($OD_{620}$=0.2). The suspensions were spread onto TSA plates and left to air-dry. Wells were bored into the agar with a sterile glass tube (d=10 mm) and filled with 200 μL cell-free bacterial culture supernatant. The plates were then incubated at room temperature (~21° C.) and the diameters of the inhibition zones around the wells were measured after 2 d. For the control, 200 μL TSB were added to one well. Plates were incubated under the same conditions described in previous sections. Each treatment was performed in triplicate.

1.8 In Vitro Growth and Co-Culture Competition

The growth and competition of the active strains were measured by co-culturing them with *E. amylovora* S435, S153 or S1605 in liquid media. Using TSB cultures incubated overnight, 50 μL of each test bacterium (diluted to $OD_{620}$=0.02) were mixed with 50 μL *E. amylovora* strains ($OD_{620}$=0.02) and cultivated in 3 mL TSB at 30° C. with agitation at 150 rpm for 24 h. Serial dilutions up to $10^{-6}$ were then prepared. One hundred microliters of each co-culture dilution were spread onto TSA plates and incubated at room temperature (~21° C.). After 2-3 d, the colony-forming units (CFUs) were counted (*Erwinia* colonies were always distinct from the test isolates). For the control, 50 μL of pure *E. amylovora* 5435 ($OD_{620}$=0.02) was cultured.

1.9 Identification of Bacterial Isolates

DNA Extraction

DNA of active bacterial isolates were extracted according to Fastprep™ procedures and instruments (MP Biomedicals, Solon, Ohio, USA) The dry DNA pellet was resuspended in 50 μL sterile $ddH_2O$ and maintained at −20° C.

16S rRNA Gene Sequence Analysis

PCR amplification of the gene encoding the 16S rRNA was performed to identify the isolates of interest according to the Table 1A below.

TABLE 1A

Primers used to determine 16S rRNA and specific genes of active bacterial isolates

| Target | Primers | Sequence 5'→3' | Approx. product size (bp) |
|---|---|---|---|
| rpoB gene | rpoB-f | AGGTCAACTAGTTCA GTATGGAC (SEQ ID NO: 1) | 579 |
| | rpoB-r | AAGAACCGTAACCGG CAACTT (SEQ ID NO: 2) | |
| rpoB gene | rpoB1698f | AACATCGGTTTGATC AAC (SEQ ID NO: 3) | |
| | rpoB2041r | CGTTGCATGTTGGTA CCCAT (SEQ ID NO: 4) | |
| gyrA gene | gyrA-f | CAGTCAGGAAATGCG TACGTCCTT (SEQ ID NO: 5) | 1025 |
| | gyrA-r | CAAGGTAATGCTCCA GGCATTGCT (SEQ ID NO: 6) | |
| gyrB gene (amplification) | UP-1 | GAAGTCATCATGACC GTTCTGCAYGCNGGN GGNAARTTYGA (SEQ ID NO: 7) | 1200 |
| | UP-2r | AGCAGGGTACGGATG TGCGAGCCRTCNACR TCNGCRTCNGTCAT (SEQ ID NO: 8) | |
| gyrB gene (sequencing) | UP-1S | GAAGTCATCATGACC GTTCTGCA (SEQ ID NO: 9) | 1200 |
| | UP-2Sr | AGCAGGGTACGGATG TGCGAGCC (SEQ ID NO: 10) | |
| | T7 | TTGTAATACGACTCA CTATAGGG (SEQ ID NO: 11) | |
| 16 sRNA | pA-27f-YM | AGAGTTTGATYMTGG CTCAG (SEQ ID NO: 12) | 1500 |

TABLE 1A-continued

Primers used to determine 16S rRNA and specific genes of active bacterial isolates

| Target | Primers | Sequence 5'→3' | Approx. product size (bp) |
|---|---|---|---|
| | pH | AAGGAGGTGATCCAR CCGCA (SEQ ID NO: 13) | |

PCR was carried out in a 50-μL reaction mixture consisting of 1× Taq buffer, 200 dNTPs mix, 0.4 μM pA-27f-YM, 0.4 μM pH, 1 unit Feldan Taq DNA Polymerase (BioBasic Canada Inc., Markham, Ontario, Canada), and 50 ng extracted DNA. The amplifications were performed in a C1000 Touch™ Thermal Cycler (Bio-Rad Laboratories Ltd., Mississauga, Ontario, Canada) using an initial DNA denaturation step of 5 min at 95° C. followed by 29 cycles of 30 s at 95° C., primer annealing for 40 s at 55° C., primer elongation for 1.5 min at 72° C., and a final extension step for 10 min at 72° C. After DNA amplification, the PCR products were analyzed by agarose gel electrophoresis (1.0% w/v agarose, 100 V, 60 min). The DNA was stained with ethidium bromide (0.5 μg/mL) and visualized under UV illumination.

16S rRNA Gene Sequence Analysis Via Resphera Insight v 2.2

Resphera Insight v. 2.2 (Resphera Biosciences, Baltimore, Md., USA), which provides ultra-high-resolution taxonomic assignment of 16S rRNA sequences down to the species level, was used as illustrated by the manufacturer to predict an accurate consensus lineage of the active isolates.

Amplification of specific *Bacillus* and *Paenibacillus* genes: The rpoB, gyrA, and gyrB gene fragments were used as molecular diagnostic markers to identify isolates within the *Bacillus subtilis* group. To this end, specific primers for the amplification of each gene were used (Table 1A). PCR amplifications were carried out in a 25-4, reaction mixture as described above, using the appropriate forward and reverse primers. The amplifications were performed using specific PCR temperature protocols. After DNA amplification, the rpoB, gyrA, and gyrB fragments were analyzed by agarose gel electrophoresis (Tables 1A and 1B).

TABLE 1B

Temperature program for amplification of DNA fragments of specific genes by PCR

| | Protocol | | | |
|---|---|---|---|---|
| Step | rpoB | gyrA | gyrB | |
| 1 | 5 min @ 95° C. | 5 min @ 95° C. | 5 min @ 95° C. | initial denaturation |
| 2 | 1 min @ 95° C. | 30 s @ 95° C. | 1 min @ 95° C. | denaturation |
| 3 | 1 min @ 51° C. | 45 s @ 51° C. | 1 min @ 60° C. | annealing |
| 4 | 1 min @ 72° C. | 1 min @ 72° C. | 2 min @ 72° C. | elongation |
| 5 | Repeat steps 2-4 | Repeat steps 2-4 | Repeat steps 2-4 | 29× |
| 6 | 10 min @ 72° C. | 10 min @ 72° C. | 10 min @ 72° C. | final elongation |
| 7 | ∞ 4° C. | ∞ 4° C. | ∞ 4° C. | stop PCR reaction and refrigerate DNA products |
| 8 | end | end | end | |

To refine the identification of the *Paenibacillus* spp. isolates, the rpoB gene was amplified (Table 1B). PCR amplifications were carried out in a 25-4, reaction mixture with 1× Taq buffer, 200 μM dNTPs mixture, 0.4 μM of each primer, 1 unit Feldan Taq DNA Polymerase, and 50 ng bacterial DNA. The amplifications were performed as described above except that the primer was elongated for 35 s at 72° C. After DNA amplification, the rpoB fragments (240 bp) were analyzed by agarose gel electrophoresis.

All PCR products were excised and purified from the agarose gel using a gel extraction kit (Bio Basic Canada Inc., Markham, Ontario, Canada) and sequenced at Institut de recherches cliniques de Montreal (IRCM). The same primers were used for the initial PCR reaction and the sequencing reactions with 16S rRNA and the rpoB gene from the *Paenibacillus* sp. isolates. The rpoB fragments from the *Bacillus* sp. isolates were cloned into a pGEM-T-Easy Vector™ (pGEM-t Easy Kit, Promega, Madison, Wis., USA) and sequenced using the universal primers Sp6 and T7. The gyrA fragments were sequenced with the same primers used in the initial PCR. The gyrB fragments were amplified with the universal primers UP-1 and UP-2r and sequenced with the UP-1S and the UP-2Sr primers.

The sequences obtained for each isolate were processed with the BioEdit™ sequence alignment editor (*Ibis* Therapeutics, Carlsbad, Calif., USA) and analyzed with Ribosomal Database Project RDP (https://rdp.cme.msu.edu/segmatch/segmatch_intro.jsp). If the sequence identity was >99%, it was considered that the bacterial isolates belonged to the same species. If the sequence identity was >97%, then the strains were classified in the same genus or family.

1.10 in Planta Testing

Treatment of Apple Leaves and Fruits

For leaf inoculation, *E. amylovora* 5435 was grown for 24 h in 3 mL TSB with shaking at 200 rpm. The culture was diluted with fresh sterile TSB to $OD_{620}$=0.2 which was equivalent to $2\times10^8$ CFU/mL. Silwet L-77 surfactant at a final concentration of 0.025% (v/v) was added to the cell suspension to facilitate penetration of the pathogenic bacteria. McIntosh leaves were collected from apple orchards (IRDA) and stored at 4° C. for 1-5 days prior to treatment. Sterile scissors were soaked in 1 mL *E. amylovora* S435 suspension and used to cut three McIntosh apple leaves replicates per strain in order to inoculate them with *E. amylovora* S435 (one cut of 2-3 cm per leaf). The test strains were grown in 10 mL TSB medium for 2 d at 30° C. and 200 rpm. About 30 min after leaf inoculation, 1 mL per leaf of test strains culture were sprayed with sterile sprayers. They were then stored in Petri dishes unto sterile wet Whatman filter papers and incubated in a growth chamber (25° C., 40% relative humidity (RH), 16-h light/8-h dark photoperiod) for 10 d to determine the efficacy of the isolates against fire blight infection by comparing treated vs. untreated infected leaves which were sprayed with sterile TSB only.

For fruit inoculation, 1 mL *E. amylovora* S435 culture, diluted with fresh sterile TSB to $OD_{620}$=0.2, was injected into McIntosh apples (IRDA orchard) with three fruit replicates per strain using a sterile syringe (one injection 3-5 cm deep per apple). About 30 min after the *Erwinia* inoculation, the test isolates were prepared as described above. One milliliter of each isolate was injected into the same inoculation site on the fruit. The fruits were then incubated in a growth chamber as described above to determine the efficacy of the isolates by comparing treated vs. untreated infected fruit injected with sterile TSB only. The leaves and fruits were evaluated for disease severity by visually rating the percentage of leaf tissue and fruit with lesions 2-10 d after inoculation.

1.11 Biological Control Products Formulation

Six strains were selected from the antagonistic and antimicrobial activity assays based on their ability to control *E. amylovora* in vitro. Each of these products was formulated to suppress the pathogen via the active live strains and the secreted metabolites.

Formulation of Spore-Forming Bacteria

To formulate two products based on strains of *P. polymyxa* 273 and *B. velezensis* (formerly known as *Bacillus amyloliquefaciens*) subsp. *plantarum* FL50S, Schaeffer's sporulation medium (SSM) was used. After incubation for 72 h at 30° C. with agitation at 200 rpm, the cultures were heated for 10 min at 80° C. to kill any vegetative bacteria. These two products, each containing sporulated bacteria and supernatant extracellular metabolites, were prepared in triplicate and stored in polypropylene bottles at room temperature (~21° C.). The effect of heating on the activity of cell-free supernatants (CFS) was evaluated and found to not significantly affect antimicrobial activity.

Formulation of Vegetative Bacteria

For the formulation of products based on vegetative bacteria, *P. poae* FL10F, *P. fluorescens* IRDA4, *P. agglomerans* NY60 and NY130 were cultivated in Difco Nutrient Broth (Becton, Dickinson and Co., Franklin Lanes, N.J., USA) supplemented with 0.5% w/w glycerol to promote the production of secondary metabolites. Each culture was incubated for 2 d at 30° C. with agitation at 200 rpm. Then, NaCl was added at a final concentration of 4% w/w to preserve the bacterial products. Each formulated product, consisting of both vegetative bacteria and their supernatant extracellular metabolites, was prepared in triplicate and stored in polypropylene bottles at room temperature (~21° C.). The same products were formulated as described above but without the addition of NaCl to assess the residual antibacterial action of the isolates (bacteria and metabolites) without preservative.

1.12 Stability and Survival of Stored Isolates In Vivo

Apple leaves (McIntosh) were disinfected by soaking them in 70% v/v ethanol for 1 min. They were then air-dried under a sterile hood for 30 min. Formulation of test bacteria that had been stored at room temperature (~21° C.) for 3 months were diluted at a rate of one part product in twenty parts sterile water. One milliliter of this solution was applied to each leaf with a trigger sprayer. The leaves were incubated on wet filters for 7 d at 25° C. and 40% RH. Three leaves were selected at t=0 and another three were selected after 7 d to count CFUs. Each leaf was cut with sterile scissors, soaked in 5 mL NaCl (0.85% w/v), vortexed for 1 min, and incubated for 30 min with shaking at 200 rpm. Dilution series were prepared and used to inoculate TSA count plates. Three replicates were performed for each treatment described above.

1.13 Management of Fire Blight on Shoots in Apple Trees

A trial was conducted at the IRDA research station in Saint-Bruno-de-Montarville, Québec to evaluate the efficacies of the best isolates previously screened. To simulate fire blight, *Malus* x *domestica* 'McIntosh' cultivar trees were inoculated then treated 2 h later with 20% (w/w) isolate dilutions. Inoculum was obtained by suspending a 5-d culture of the virulent strain *E. amylovora* 5435 in potassium phosphate buffer (pH=6.5) in King B agar which favors the growth of this phytopathogen. The bacterial density was adjusted to $\sim1\times10^9$ CFU/mL. Actively growing potted trees (cv. McIntosh grafted onto M26) were inoculated by transversely bisecting the two youngest leaves with scissors dipped in the inoculum. One or two shoots were inoculated per tree. Two hours after inoculation, candidate biological control agent suspensions were sprayed to runoff onto five trees per treatment using a low-pressure sprayer. The experimental design was completely randomized.

Inoculated controls were sprayed either with water or with the medium used to formulate the candidate biocontrol products. Uninoculated controls were sprayed only with water. The medium applied in Treatment 3 was the same one used to cultivate *P. poae* FL9F, *P. poae* FL10F, *P. agglomerans* NY60, *P. agglomerans* NY130, and *P. fluroescens* IRDA4. It consisted of Nutrient Broth NB supplemented with 0.5% w/w glycerol and a 4% w/w NaCl. The trees were incubated in a growth chamber at 25° C. and observed 2, 4, 7, and 10 d after treatment. Disease severity (DS) was rated as follows: 0=absence of necrosis; 1=necrosis limited to central vein of inoculated leaves; 2=necrosis extending to petiole; 3=necrosis reaching shoot; 4=necrosis reaching other leaves on the inoculated shoot. Fire blight severity scores were reported only 10 d after inoculation. No disease was found on the uninoculated controls. Severity scores were analyzed with a cumulative link mixed model (clmm) in the "ordinal" package of R. Treatment and observation date were used as fixed effects. Individual trees were used as a random effect.

1.14 Field Trial to Control Fireblight on Rome Cultivars in Geneva NY (USA)

A field trial was conducted to determine the performance of the formulated product based on the vegetative cells of *Pseudomonas poae* FL10F and its extracellular metabolites produced in the supernatants and was compared to antibiotic (FireWall 17 WP Streptomycin), copper fungicide (Cueva, Certis, USA) and the biological product Blossom Protect based on two strains of *Aureobasidium pullulans*. The strain (*P. poae* FL10F) was selected because it demonstrated the strongest in vitro antagonistic and antimicrobial activity against *E. amylovora* S435, S153 and S1605. Both antibiotic and copper that were used in this trial were EPA registered products. *Pseudomonas poae* FL10F was cultivated for 2 days at 30° C. and 200 rpm and reached an $OD_{600\ nm}$=2.50, which was empirically determined to represent $2.50\times10^9$ CFU/mL by plating serial dilutions of the suspension and counting colonies. A 4L of product based on *Pseudomonas poae* FL10F and its metabolites was produced as described above and was sprayed more than 2 months later on apple Rome trees. Three samples of this formulated product were retained in sterile 50 mL polypropylene centrifuge tubes at room temperature for long-term activity and bacterial count studies.

The 4L product was used during in a field trial conducted in Phelps, (Geneva) NY to evaluate the product against fire blight. Apple Rome were used for this study that had 5 to 12 blossom clusters per tree. These were 1-year-old trees from Waffler Nursery, Wolcott, N.Y.

The experimental treatments were applied using a $CO_2$ Backpack sprayer that was calibrated to deliver 100 gallons per acre (Trees were sprayed to first drip with a "dilute" solution of products.) The sprayer was calibrated at 42 PSI and used 2 Hollow Cone (TXVK18) Nozzles.

An evaluation of treatments was conducted using the method where scissors were dipped into a solution of a streptomycin sensitive *Erwinia amylovora* strain S01, and the two smallest leaves on each terminal or shoot were cut in half. This severe test is used to simulate infection that can occur following hailstorms. The scissors were dipped into the *Erwinia amylovora* S01 solution prior to each cut. The apical terminal shoot and the terminal leaves on any side shoots were cut. For the size of these trees, the number of terminals that were cut varied from 9 to 18. To evaluate the treatments for this method, each treatment was applied as before to all leaves and shoots of seven individual trees. The inoculations occurred near dusk, and 1.15 inches of rain occurred during the overnight period. All treatments were applied 30 minutes before the infection and then re-applied 24 hours after the initial inoculation. The second application of treatments was applied to the same trees. The product based on Fluorescent *Pseudomonas poae* FL10F and its metabolites was first diluted at a concentration of 20% (w/w) with water then it was mixed properly and sprayed.

At 3 weeks following the scissor inoculation, each terminal shoot was rated for the length in inches with typical symptoms of fire blight (rated as SEVERITY). Then the percentage of all shoots that had any symptoms of fire blight was calculated as INCIDENCE).

Example 2: Isolation of Bacterial Isolates and In Vitro Screening for Anti-*E. amylovora* Activity The leaves, flowers, stems, and fruits of apples, pears, tomatoes, and strawberries, and agricultural field soil samples, were collected from various locations from 2011-2015, as described in Table 2.

TABLE 2

Environmental samples collected from various locations for bacterial isolation

| Sample | Location source and sampling date | Number of samples |
|---|---|---|
| Agricultural field soil | [A]: Apple and pear orchards, Mont-Saint-Bruno (IRDA) Québec, Canada, September 2014 | 4 |
| Agricultural field soil | [B]: Apple and pear orchards, Oka, Québec, Canada, September, 2014 | 3 |
| Agricultural field soil | [C]: Sherrington, Québec, Canada, September, 2014 | 4 |
| Agricultural field soil | [D]: Wimauma, Florida, USA, April, 2013 | 1 |
| Agricultural field soil | [E]: Sherrington, Québec, Canada, November, 2011 | 4 |
| Agricultural field soil | [F]: Wimauma, Florida, USA, July, 2012 | 2 |
| Strawberry leaves | [G]: Dover, Florida, USA, April, 2013 | 1 |
| Tomato leaves and fruits | [H]: Wimauma, Florida, USA, July, 2012 | 3 |
| Apple (McIntosh and Honeycrisp cultivars) and pear (Beauté Flamande cultivar) leaves, stems, and fruits | [I]: Apple and pear orchard, Mont-Saint-Bruno (IRDA), Québec, Canada, September, 2014 | 4 |

TABLE 2-continued

| Environmental samples collected from various locations for bacterial isolation | | |
|---|---|---|
| Sample | Location source and sampling date | Number of samples |
| Tomato leaves and fruits | [J]: Sherrington, Québec, Canada, November, 2011 | 4 |
| Leaves, stems, and fruits of various plants | [K]: Orchard, Laval, Québec, Canada, September, 2014 | 4 |
| Flowers, leaves, stems, and soil of Empire, Marshall McIntosh, Cortland, Mcintosh, Paula Red, Honey crisp, Royal Court and Lobo apple cultivars | [L]: Apple and pear orchards, Mont-Saint- Bruno (IRDA), Québec, Canada, May-September, 2015 | 30 |
| Apple leaves, stems, and soil | [M]: Apple trees, Laval, Québec, Canada, June, 2015 | 5 |
| Rome apple leaves and stems | [N]: Geneva, New York, USA, July, 2015 | 5 |
| Pear flowers, leaves, and stems | [O]: Laval, Québec, Canada, May, 2015 | 5 |
| | Total | 79 |

A total of 79 environmental samples were analyzed. About 5,000 isolates were tested against *E. amylovora* 5435 using a direct antagonistic activity assay as the first screening step. Of all the isolates assayed, 205 strains produced inhibition zones of varying diameters on a lawn of *E. amylovora* S435 (FIG. 1A). These 205 selected isolates were stored at −80° C., and the antagonistic screening process was repeated three times with similar results.

Figure 1B:
FIG. 1B shows antimicrobial activity of two bacterial isolate cell-free supernatants (CFS) against a lawn of *E. amylovora* S435, wherein inhibition zones are indicated by dotted circles. Left: isolate *P. poae* FL3F; Right: isolate *P. poae* FL4F.
Figure 2A:
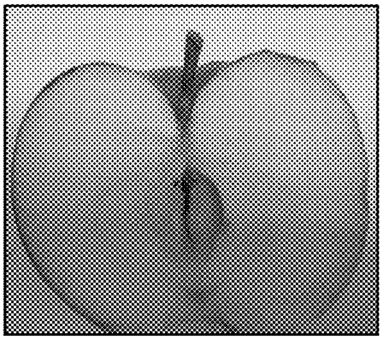
FIGS. 2A-2G show representative images of apples inoculated with *E. amylovora* and treated with various antimicrobial control agents or antibiotics. Apples were cut 10 d after treatment.
Figure 2B:
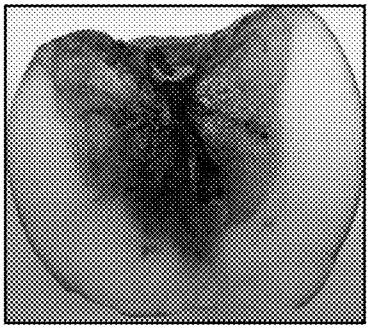
Figure 2C:
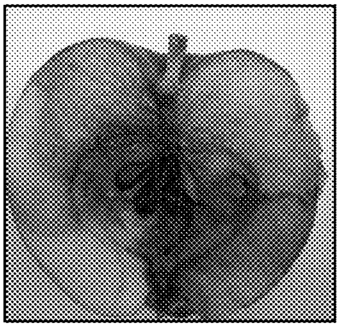
Figure 2D:
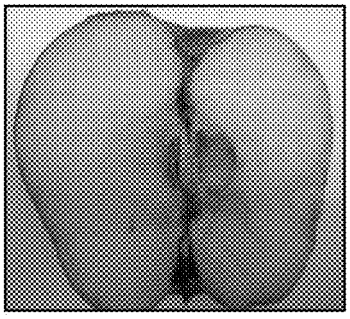
Figure 2E:
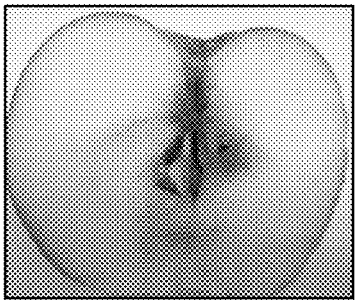
Figure 2F:
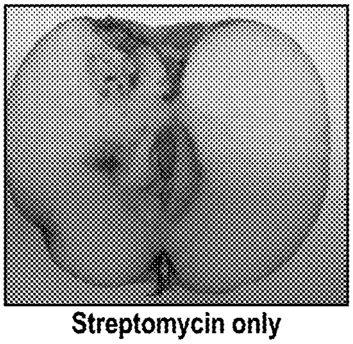
Figure 2G:
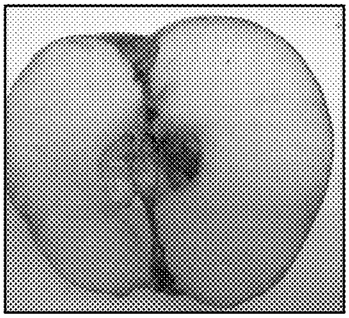
Figure 3A:
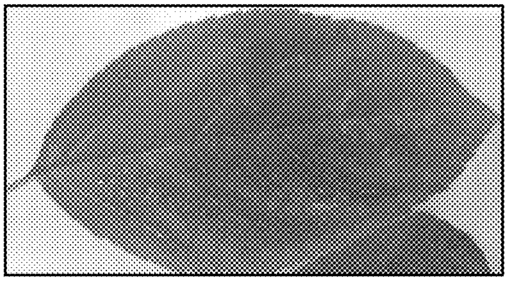
FIGS. 3A-3G show apple leaves cut with scissors inoculated with *E. amylovora* S1605 at $OD_{620}$=0.2 and treated with various antimicrobially active isolates. Observations were made 10 d after inoculation.
Figure 3B:
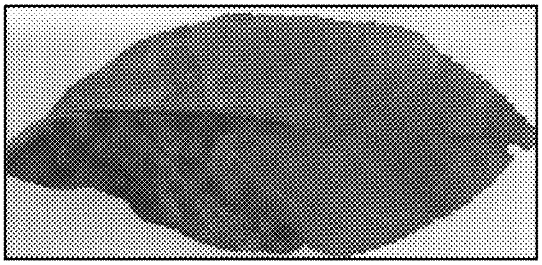
Figure 3C:
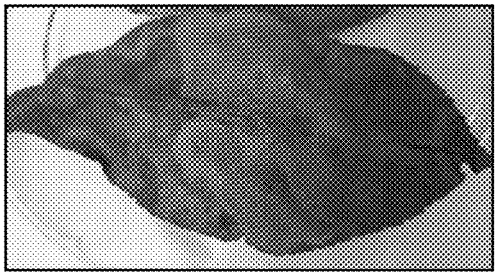
Figure 3D:
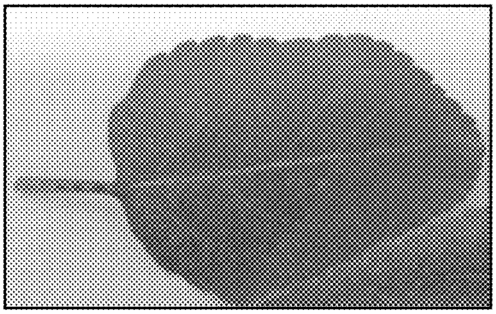
Figure 3E:
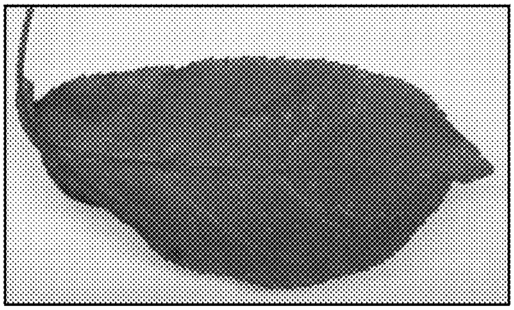
Figure 3F:
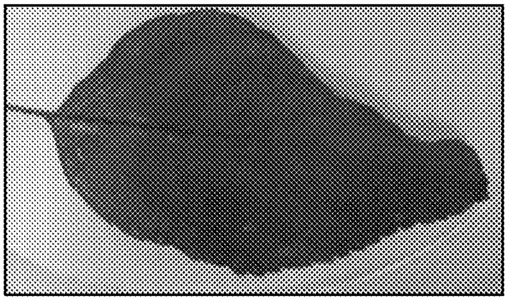
Figure 3G:
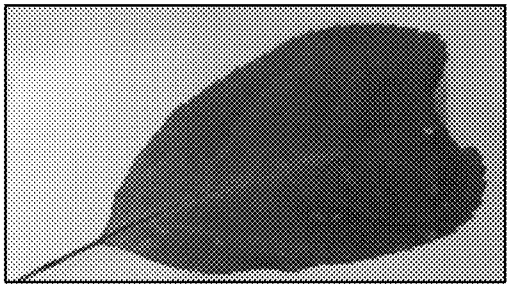

For the second screening step, the extracellular antimicrobial activities of the 205 isolates were determined and 32 isolates were retained for their cell-free supernatants (CFS) activities (FIG. 1B and Table 3). The CFS of *P. polymyxa* 273, *P. poae* FL10F, and *B. velezensis* subsp. *plantarum* FL50S, displayed the strongest activity against *E. amylovora* S435. They also inhibited the growth of streptomycin-resistant *E. amylovora* S153 and *E. amylovora* S1605 (Tables 3 and 4). Cell-free supernatants from these three isolates formed inhibition halos 25.0-35.0 mm in diameter on *E. amylovora* S435 cultures and were subjected to further analyses in Table 4.

TABLE 3

| Activities of CFS against *Erwinia amylovora* S435 | | | | | |
|---|---|---|---|---|---|
| Bacterial isolates/ 16S rRNA gene sequence identification = 99% similarilty | Source | Medium of isolation | Diameter of growth inhibition zone (including well diameter)*, mm | 2-fold diluted CFS | 10-fold diluted CFS |
| *Paenibacillus polymyxa* 273 | [E] | Benedict | 26.66 ± 0.34 | 21.00 ± 0.36 | 17.58 ± 0.50 |
| *Paenibacillus polymyxa* 344 | [J] | TSA | 23.67 ± 0.21 | 17.08 ± 0.27 | no inhibition |
| *Bacillus velezensis* subsp. *plantarum* FL50S | [F] | PCA | 28.58 ± 0.33 | 27.16 ± 0.21 | 19.08 ± 0.27 |
| *Bacillus velezensis* 304 | [E] | Benedict | 27.25 ± 0.30 | 20.16 ± 0.30 | No inhibition |
| *Bacillus* sp. FD308 | [A] | TSA | 27.42 ± 0.41 | 25.16 ± 0.27 | No inhibition |
| *Bacillus* sp. 331 | [J] | TSA | 28.30 ± 0.42 | 20.50 ± 0.43 | No inhibition |
| *Bacillus* sp. FD402 | [B] | TSA | 24.50 ± 0.43 | 20.16 ± 0.47 | No inhibition |
| *Bacillus velezensis* 417 | [E] | TSA | 27.33 ± 0.60 | 20.16 ± 0.60 | No inhibition |
| *Bacillus* sp. 418 | [E] | TSA | 26.75 ± 0.31 | 19.58 ± 0.25 | No inhibition |
| *Bacillus subtilis* 421 | [E] | TSA | 25.16 ± 0.21 | 22.66 ± 0.42 | No inhibition |
| *Bacillus velezensis* 431 | [E] | TSA | 27.16 ± 0.40 | 20.16 ± 0.30 | No inhibition |
| *Bacillus* sp. FD604 | [A] | TSA | 27.41 ± 0.20 | 21.33 ± 0.49 | No inhibition |
| *Bacillus* sp. IRDA27 | [L] | TSA | 25.50 ± 0.34 | 20.16 ± 0.30 | No inhibition |
| *Bacillus* sp. IRDA63 | [L] | TSA | 23.50 ± 0.34 | 17.08 ± 0.27 | No inhibition |
| *Bacillus* sp. IRDA618 | [L] | TSA | 23.50 ± 0.50 | 19.50 ± 0.18 | No inhibition |
| *Bacillus* sp. IRDA619 | [L] | TSA | 21.50 ± 0.50 | 16.50 ± 0.22 | No inhibition |
| *Bacillus* sp. IRDA627 | [L] | TSA | 25.50 ± 0.34 | 20.16 ± 0.30 | No inhibition |
| *Bacillus* sp. IRDA672 | [L] | TSA | 24.00 ± 0.50 | 21.50 ± 0.34 | No inhibition |
| *Bacillus* sp. IRDA675 | [L] | TSA | 23.50 ± 0.50 | 16.50 ± 0.22 | No inhibition |
| *Bacillus* sp. IRDA683 | [L] | TSA | 29.16 ± 0.30 | 25.16 ± 0.27 | No inhibition |
| *Bacillus* sp. IRDA684 | [L] | TSA | 24.00 ± 0.50 | 21.50 ± 0.34 | No inhibition |
| *Bacillus* sp. IRDA685 | [L] | TSA | 25.50 ± 0.34 | 21.00 ± 0.36 | No inhibition |
| *Bacillus* sp. IRDA687 | [L] | TSA | 22.50 ± 0.50 | 17.08 ± 0.27 | No inhibition |
| *Pseudomonas poae* FL3F | [G] | PCA | 28.10 ± 0.27 | 25.16 ± 0.30 | 19.50 ± 0.18 |
| *Pseudomonas poae* FL4F | [G] | PCA | 29.92 ± 0.20 | 23.75 ± 0.31 | 21.50 ± 0.34 |
| *Pseudomonas poae* FL9F | [G] | PCA | 26.00 ± 0.26 | 23.50 ± 0.34 | 16.50 ± 0.22 |
| *Pseudomonas poae* FL10F | [G] | PCA | 35.08 ± 0.27 | 30.41 ± 0.37 | 25.10 ± 0.27 |
| *Pseudomonas fluorescens* IRDA4 | [L] | TSA | 29.16 ± 0.30 | 19.50 ± 0.18 | No inhibition |
| *Pseudomonas* sp. 41 | [L] | TSA | 23.25 ± 0.36 | 20.16 ± 0.30 | No inhibition |
| *Pseudomonas* sp. 42 | [L] | TSA | 23.33 ± 0.35 | 17.08 ± 0.27 | No inhibition |
| *Pseudomonas* sp. 43 | [L] | TSA | 23.50 ± 0.34 | 19.58 ± 0.25 | No inhibition |
| *Pseudomonas* sp. NY1238 | [L] | TSA | 21.17 ± 0.40 | 16.50 ± 0.22 | No inhibition |
| *Pantoea agglomerans* NY50 | [N] | TSA | No activity | No activity | No activity |

TABLE 3-continued

Activities of CFS against *Erwinia amylovora* S435

| Bacterial isolates/ 16S rRNA gene sequence identification = 99% similarilty | Source | Medium of isolation | Diameter of growth inhibition zone (including well diameter)*, mm | 2-fold diluted CFS | 10-fold diluted CFS |
|---|---|---|---|---|---|
| *Pantoea agglomerans* NY60 | [N] | TSA | No activity | No activity | No activity |
| *Pantoea agglomerans* NY130 | [N] | TSA | No activity | No activity | No activity |
| *Pantoea agglomerans* IRDA36 | [L] | TSA | No activity | No activity | No activity |
| *Pantoea agglomerans* IRDA59 | [L] | TSA | No activity | No activity | No activity |

Tryptic Soy Agar (TSA), Plate Count Agar (PCA).
Benedict, ± Standard error of the mean (SEM) of three replicates,
*Well diameter = 10 mm.

TABLE 4

Efficacies of the extracellular metabolites of *P. polymyxa* 273, *B. velezensis* FL50S and *Pseudomonas poae* FL10F against *E. amyloyora* S153 and S1605

| Bacterial isolates | Diameter of growth inhibition zone of *E. amylovora* strains (including well diameter)*, mm S153 | S1605 |
|---|---|---|
| *Paenibacillus polymyxa* 273 | 25.00 ± 0.25 | 25.58 ± 0.37 |
| *Bacillus velezensis* subsp. *plantarum* FL50S | 27.30 ± 0.42 | 27.83 ± 0.40 |
| *Pseudomonas poae* FL10F | 29.58 ± 0.52 | 33.08 ± 0.27 |

± Standard error of the mean (SEM) of three replicates,
*Well diameter = 10 mm.

To increase agar diffusion assay sensitivity and address relative differences in metabolite solubility, CFS of the strains most active against *E. amylovora* (with the largest inhibitory zones, Table 3) were diluted by 2-fold and 10-fold, and the *E. amylovora* S435 inhibition zone assays were repeated. CFS from six of the isolates retained some inhibitory activity even at a 10-fold dilution: *P. polymyxa* 273; *B. velezensis* subsp. *plantarum* FL50S; *P. poae* FL3F; *P. poae* FL4F; *P. poae* FL9F; and *P. poae* FL10F (see Table 3).

Surprisingly, a subgroup of five *P. agglomerans* isolates (NY50, NY60, NY130, IRDA36, IRDA59) selected because of their strong inhibitory activity in direct antagonism assays (see e.g., Table 5), even in comparison to a plurality of other isolates from the same species eliminated following the first screenings, produced CFS with no visible inhibitory activity against *E. amylovora* S435 (see Table 3).

TABLE 5

Direct antagonistic activity of *Pantoea* isolates against *E. amylovora* S435

| Bacterial isolates | *Pantoea* colony diameter (mm)/inhibition zone on *E. amylovora* S435 lawn (including *Pantoea* diameter in mm) |
|---|---|
| *P. agglomerans* NY50 | 11.33 ± 0.33/28.33 ± 0.33 |
| *P. agglomerans* NY60 | 10.00 ± 0.57/30.66 ± 0.33 |
| *P. agglomerans* NY130 | 10.66 ± 0.66/31.33 ± 0.66 |
| *P. agglomerans* IRDA36 | 10.66 ± 0.66/25.33 ± 0.66 |
| *P. agglomerans* IRDA59 | 10.33 ± 0.66/26.33 ± 0.88 |

All strains were isolated on TSA plates.
±Standard error of the mean (SEM) of three replicates

Example 3: In Planta Testing of Apples and Leaves Inoculated with *E. amylovora*

Two in planta experiments were then performed: (1) infections of apples by *E. amylovora* and subsequent injection of an active strain, and (2) infection of apple leaves by *E. amylovora* via scissor-cutting and subsequent spraying of active strains, to assess their biocontrol potential. The 37 active strains were tested in these in planta experiments.

Strikingly, some *P. agglomerans* strains (e.g., NY60) showed comparable efficacy to the streptomycin antibiotics, controlling around 80% disease severity in apples and around 40% in leaves as shown in FIGS. 2 and 3. No phytotoxicity was observed with the *P. agglomerans* NY60 treatment. Disease symptoms on the leaves were observed and recorded independently by two separate technicians. Disease severity and incidence assessments were made based on the results compiled from three separate experiments.

Example 4: Identification of Active Isolates 4.1 16S rRNA

A 1.6-kb 16S rRNA DNA fragment was amplified and sequenced for each bacterial isolate. Thirty-seven bacterial isolates were identified by gene sequencing (Table 3), including 21 isolates belonging to the *Bacillus subtilis* group and 2 isolates belonging to the *Paenibacillus* genus. Analysis of pairwise 16S rDNA sequence alignments were highly similar to each other at the genus level, but could not be used to distinguish different but closely related bacterial species such as *P. polymyxa, P. peoriae, P. jamilae*, and *P. kribbensis*. Nine isolates belonging to the fluorescent *Pseudomonas* group and five isolates belonging to the *Pantoea agglomerans* species were also identified.

4.2 Further Identification of *Pseudomonas* and *Pantoea* Strains Using Resphera Insight™ (v2.2)

Resphera Insight™ (v2.2) which is a clinical-grade proprietary analysis protocol developed to provide ultra-high-resolution taxonomic assignment of 16S rRNA sequences to species-level membership was used to further identify *Pseudomans* and *Pantoea* strains. This computationally intensive procedure maintains the capacity for 99.9% sensitivity and >99.5% species-level specificity for hundreds of bacterial strains, and in cases of ambiguous membership, predicts an accurate consensus lineage. The results Resphera Insight™ (v2.2) were supportive to the 16S rRNA findings (Tables 6 and 7).

TABLE 6

Summary of further *Pseudomonas* strains identification for isolates FL10F, FL9F, FL3F and IRDA4

| Isolates | FL10F CFSAN034337 | FL9F CFSAN055119 | FL3F CFSAN 034336 | IRDA4 CFSAN055120 |
|---|---|---|---|---|
| | Isolates identification (% similarity) | | | |
| Resphera Insight | *Pseudomonas poae* 99% | *Pseudomonas poae* 99% | *Pseudomonas poae* 98% | Fluorescent *Pseudomonas* spp. 99% |

TABLE 7

Summary of further *Pantoea* strains identification for isolates NY60 and NY130

| Isolates | NY60 CFSAN047153 | NY130 CFSAN047154 |
|---|---|---|
| | Isolates identification (% similarity) | |
| Resphera Insight | *Pantoea agglomerans* 99% | *Pantoea agglomerans* 99% |

4.3 Identification of Isolates Via gyrA, gyrB and rpoB Gene Sequences

The gyrA and gyrB sequences were used to discriminate the isolates belonging to the *Bacillus subtilis* group. Isolate 50S most closely resembled *Bacillus velezensis*; their sequence similarity was 99%. Partial sequencing of the gene encoding the B protein subunit of DNA gyrase (gyrB) was performed on the FL3F, FL4F, FL9F, and FL10F isolates, all of which most nearly resemble a *Pseudomonas fluorescens* group strain with sequence similarities of 99-100%. Based on the rpoB gene sequence, isolate 273 was 99% similar to a *P. polymyxa* strain.

4.4 Whole-Genome Sequencing

Genomic DNA was isolated from an overnight culture of each strain using a QiagenDNeasy™ blood and tissue kit (Qiagen Inc., Valencia, Calif.). Genome sequencing was performed using Illumina MiSeg™ sequencing system (Illumina, San Diego, Calif.), achieving >50× average genome coverage. De novo assembly was created for each genome using SPAdes 3.0.0 (St. Petersburg genome assembler) and annotated with the NCBI Prokaryotic Genomes Automatic Annotation Pipeline (http://www.ncbi.nlm.nih.gov/genomes/static/Pipeline.html). Taxonomy of each isolate was assigned using Kraken.

The two-way ANI calculator (http://enve-omics.ce.gatech.edu/ani/index) was used to estimate the average nucleotide identity between genomic datasets of the best anti-*Erwinia* bacterial isolates and already known type strains of *Pantoea, Pseudomonas, Paenibacillus* and *Bacillus* species from NCBI database (http://www.ncbi.nlm.nih.gov/nuccore). If the ANI value between two genomes is above 95%, it means that two isolates belong to the same species.

4.5 Complete Genome Sequencing

Genome mining of biosynthetic gene clusters including non-ribosomal peptide synthetases (NRPSs) and other secondary metabolites were predicted with antibiotics & Secondary Metabolite Analysis SHell (antiSMASH) web server (http://antismash.secondarymetabolites.org/).

For the strain 273, the genome coverage was as high as 88% (N50=364,236 bp) and the resulting number of contigs was calculated to be 206. Only 7.37% of the reads were unclassified which reflect the accuracy of the species identification. The confidence score and species check percentage was as high as 90.91% indicating that the strain 273 is indeed a *Paenibacillus polymyxa* species.

Concerning the strain FL50S, the genome coverage was as high as 78% (N50=132,866 bp) and the resulting number of contigs was calculated to be 105. Only 5.20% of the reads were unclassified which reflect the accuracy of the species identification. The confidence score and species check percentage was as high as 93.26% indicating that the strain FL50S is indeed a *Bacillus velezensis* species with a percentage of 11.63 for the subsp. *Plantarum*. The gene clusters for non-ribosomal peptide synthetases (NRPSs) and other secondary metabolites for isolates 50S, 273, FL3F, FL9F, FL10F, IRDA4, NY60 and NY130, are illustrated in Tables 7A-7C. Strikingly, although the NY60 and NY130 strains were isolated from independent environmental samples, their genomic sequences—particularly with respect to non-ribosomal peptide synthetases and other secondary metabolites—were extremely similar suggesting that such genomic sequences may be used to identify these strains, as well as other *P. agglomerans* strains of having potent anti-*Erwinia* activity.

TABLE 7A

Summary of the complete genome sequencing and major gene clusters for non-ribosomal peptide synthetases (NRPSs) and secondary metabolites for isolates 50S and 273

| Isolate | 50S CFSAN034340 LYNC00000000: accession numbers NCBI assigned after annotation Annotated as '*Bacillus velezensis*' | 273 CFSAN034343 LYND00000000: accession numbers NCBI assigned after annotation |
|---|---|---|
| | Genome sequencing and species check | |
| Genome coverage | 78% | 88% |
| N50 (bp) | 132.866 | 364.236 |
| Number of contigs | 105 | 206 |
| Unclassified reads | 5.20% | 7.37% |
| Confidence score and species check | 93.26% for *Bacillus velezensis* | 90.91% for *Paenibacillus polymyxa* |
| Subsp. | 11.63% for *Plantarum* | – |

TABLE 7A-continued

Summary of the complete genome sequencing and major gene clusters for non-ribosomal peptide synthetases (NRPSs) and secondary metabolites for isolates 50S and 273

| Isolate | 50S CFSAN034340 LYNC00000000: accession numbers NCBI assigned after annotation Annotated as '*Bacillus velezensis*' | 273 CFSAN034343 LYND00000000: accession numbers NCBI assigned after annotation |
|---|---|---|
| Biosynthetic gene clusters % similarity for non-ribosomal peptide synthetases (NRPSs) and other secondary metabolites | | |
| Macrolactin | 100% | – |
| Bacillaene | 85% | 28% |
| Difficidin | 53% | – |
| Iturin | 22% | – |
| Bacilysin | 100% | – |
| Surfactin | 47% | – |
| Bacteriocin | – | – |
| Bacillibactin | 92% | – |
| Kalimantacin/batumin | – | – |
| Fengycin | 80% | – |
| Nosperin | – | 46% |
| Bacillomycin | – | – |
| Fusaricidin | – | 100% |
| Paenibacterin | – | 60% |
| Polymyxin | – | 100% |
| Bacitracin | – | 22% |
| Tridecaptin | – | 80% |
| Plipastatin | 23% | – |
| Teichuronic acid | 100% | – |
| Subtilin | – | – |
| Locillomycin | 28% | – |
| Myxovirescin | – | 8% |
| Citrulline | 27% | – |
| Bacitracin | – | – |
| Paenibacillin | – | – |

TABLE 7B

Summary of the complete genome sequencing and major gene clusters for non-ribosomal peptide synthetases (NRPSs) and secondary metabolites for isolates FL10F, FL9F, FL3F and IRDA4

| Isolates | FL10F CFSAN034337 | FL9F CFSAN055119 | FL3F CFSAN034336 | IRDA4 CFSAN055120 |
|---|---|---|---|---|
| Isolates identification (% similarity) | | | | |
| 16S ribosomal RNA Resphera Insight | *Pseudomonas poae* 99% | *Pseudomonas poae* 99% | *Pseudomonas poae* 98% | Fluorescent *Pseudomonas* spp. 99% |
| Complete genome sequencing - Biosynthetic gene clusters % similarity for non-ribosomal peptide synthetases (NRPSs) and other secondary metabolites | | | | |
| Bacteriocin | + | + | + | + |
| Arylpolyene | 45% | 15% | 45% | 20% |
| Safracin | 90% | 70% | 90% | 90% |
| Pyoverdine | 11% | 3% | 11% | 10% |
| Mangotoxin | 57% | – | 57% | 57% |
| Poaeamide | 100% | – | 100% | 100% |
| Pyochelin | 100% | – | 80% | 80% |
| Tolaasin | – | 50% | – | – |
| Syringafactin | – | – | – | 83% |

+: gene cluster is present on the genome, but the percentage similarity is not determined.

TABLE 7C

Summary of the complete genome sequencing and major gene clusters for non-ribosomal peptide synthetases (NRPSs) and secondary metabolites for isolates NY60 and NY130.

| Isolates | NY60 CFSAN047153 | NY130 CFSAN047154 |
|---|---|---|
| Isolates identification (% similarity) | | |
| 16S ribosomal RNA | *Pantoea agglomerans* | *Pantoea agglomerans* |
| Resphera Insight | 99% | 99% |
| Complete genome sequencing - Biosynthetic gene clusters similarity for non-ribosomal peptide synthetases (NRPSs) and other secondary metabolites | | |
| Bacteriocin | + | + |
| Arylpolyene | 73% | 73% |
| Acyl homoserine lactone (Hserlactone) | + | + |
| Turnerbactin | 30% | 30% |
| Carotenoid | 100% | 100% |
| Desferrioxamine B | 40% | 60% |
| Pyocyanine | 28% | 28% |
| Microcin | + | + |

+: gene cluster is present on the genome, but the percentage similarity is not determined.

Example 5: In Vitro Competition in Co-Cultures

The in vitro competition was assessed by co-culturing active strains (i.e., those characterized in Tables 7A-7C) with *E. amylovora* S435, S153, and S1605 strains. Not all active strains completely killed all colonies of *E. amylovora* strains. Interestingly, only *Pantoea agglomerans* NY60 and NY130 completely killed *E. amylovora* strains S435, S153, and S1605 when they were co-cultivated together.

Example 6: Formulations of Products: Stability and Activity

The objective of this work was to formulate biological control products effective against fire blight on apple and pear trees. Based on the above data, six strains were selected based on their potent activity against *E. amylovora* for the development of formulations. Each of these products was formulated to have a dual mode of action via (1) live strains, and (2) metabolites present in extracellular CFS. Without being bound by theory, when the product is sprayed on the trees, the active metabolites are intended to control *E. amylovora*, while the live bacteria in the formulation are intended to grow, colonize, and outcompete any remaining or forthcoming *E. amylovora*.

The long-term survival of bacteria, and stability of the antagonistic activities of the six biological control formulations were assessed over a period of 9 months. The products were stored at room temperature (~21° C.) in plastic bottles and were found to be relatively stable during the period. Based on CFU/mL counts, the densities of both fluorescent *Pseudomonas* spp. strains and both *Pantoea* strains decreased by ~2 log, and those of those of *P. polymyxa* 273 and *B. velezensis* FL50S by ~1 log, (see Table 8, which presents the means of three replicates).

TABLE 8

Stability of the biological control product formulations

| Biological control product | Concentration of bacteria(CFU/mL) Time: Zero | 3 months | 9 months |
|---|---|---|---|
| *Paenibacillus polymyxa* 273 | $1.10 \pm 0.02 \times 10^7$ | $1.01 \pm 0.01 \times 10^7$ | $2.00 \pm 0.11 \times 10^6$ |
| *Bacillus velezensis* subsp. *Plantarum* FL50S | $2.10 \pm 0.10 \times 10^7$ | $2.00 \pm 0.10 \times 10^7$ | $1.03 \pm 0.06 \times 10^7$ |
| *Pseudomonas poae* FL10F | $1.06 \pm 0.08 \times 10^9$ | $1.96 \pm 0.14 \times 10^8$ | $1.96 \pm 0.12 \times 10^7$ |
| *Pantoea agglomerans* NY60 | $2.63 \pm 0.06 \times 10^9$ | $1.93 \pm 0.06 \times 10^9$ | $1.00 \pm 0.10 \times 10^7$ |
| *Pantoea agglomerans* NY130 | $2.56 \pm 0.03 \times 10^9$ | $1.96 \pm 0.03 \times 10^9$ | $0.96 \pm 0.13 \times 10^7$ |
| *Pseudomonas fluorescens* IRDA4 | $2.00 \pm 0.10 \times 10^9$ | $1.96 \pm 0.03 \times 10^9$ | $1.96 \pm 0.12 \times 10^7$ |

±Standard error of the mean (SEM) of three replicates

Furthermore, the inhibitory activity of the various CFS (Table 9) and the direct cell-to-cell antagonism (Table 10) of bacteria in the formulations remained active after >9 months storage at room temperature. Heating during the formulation of spore-forming bacteria-based products had no effect on the activity of CFS (Table 9).

TABLE 9

Antimicrobial activity of CFS of the biological control product formulations

| Biological control product | Diameter of growth inhibition zone (including well diameter) *, mm | | |
|---|---|---|---|
| | Time Zero | 3 months | 9 months |
| *Paenibacillus polymyxa* 273 | 26.66 ± 0.34 | 23.33 ± 0.35 | 21.67 ± 0.21 |
| *Bacillus velezensis* subsp. *Plantarum* FL50S | 28.58 ± 0.33 | 26.67 ± 0.16 | 23.50 ± 0.34 |
| *Pseudomonas poae* FL10F | 35.08 ± 0.27 | 33.00 ± 0.50 | 29.16 ± 0.30 |
| *Pseudomonas fluorescens* IRDA4 | 29.16 ± 0.30 | 27.66 ± 0.42 | 23.25 ± 0.36 |

±Standard error of the mean (SEM) of three replicates,
* Well diameter = 10 mm.
*Pantoea* strains were not tested for lack of CFS activity.

TABLE 10

Antagonistic activity of the biological control product formulations

| Biological control product | Time Zero* | 3 months* | 9 months* |
|---|---|---|---|
| *Paenibacillus polymyxa* 273 | 10.00 ± 0.57/ 24.66 ± 0.33 | 11.00 ± 0.00/ 22.66 ± 0.33 | 11.33 ± 0.66/ 22.00 ± 0.00 |
| *Bacillus velezensis* subsp. *Plantarum* FL50S | 11.00 ± 0.57/ 26.00 ± 0.00 | 11.00 ± 0.57/ 26.66 ± 0.33 | 11.00 ± 0.00/ 24.30 ± 0.33 |
| *Pseudomonas poae* FL10F | 10.66 ± 0.33/ 29.66 ± 0.88 | 9.00 ± 0.00/ 28.33 ± 0.66 | 11.00 ± 0.57/ 28.00 ± 0.57 |
| *Pseudomonas fluorescens* IRDA4 | 11.00 ± 0.57/ 29.66 ± 0.33 | 10.00 ± 0.00/ 28.30 ± 0.66 | 9.00 ± 0.00/ 26.00 ± 0.57 |
| *Pantoea agglomerans* NY60 | 10.00 ± 0.57/ 30.66 ± 0.33 | 10.66 ± 0.33/ 29.50 ± 0.28 | 10.00 ± 0.57/ 29.30 ± 0.16 |
| *Pantoea agglomerans* NY130 | 10.66 ± 0.16/ 32.33 ± 0.15 | 10.00 ± 0.57/ 30.66 ± 0.33 | 10.00 ± 0.57/ 28.50 ± 0.28 |

*Biological control product colony diameter (mm)/inhibition zone on *E. amylovora* S435 lawn (mm).
±Standard error of the mean (SEM) of three replicates Survival of formulated bacteria sprayed on apple leaves (McIntosh) was then assessed. Table 11 describes the mean of the three replicates which were performed for each treatment, showing that formulated products remained viable on apples leaves for 7 d.

TABLE 11

Survival of the biological control product formulations on leaves

| Microbial-based products | Time Zero *CFU per leaf | After 7 days *CFU per leaf |
|---|---|---|
| *Paenibacillus polymyxa* 273 | $1.25 \pm 0.006 \times 10^3$ | $1.53 \pm 0.033 \times 10^3$ |
| *Bacillus velezensis* subsp. *Plantarum* FL50S | $1.90 \pm 0.057 \times 10^4$ | $1.76 \pm 0.003 \times 10^4$ |
| *Pseudomonas poae* FL10F | $1.20 \pm 0.088 \times 10^5$ | $1.04 \pm 0.000 \times 10^5$ |
| *Pseudomonas fluorescens* IRDA4 | $1.35 \pm 0.005 \times 10^5$ | $1.35 \pm 0.005 \times 10^5$ |
| *Pantoea agglomerans* NY60 | $2.03 \pm 0.066 \times 10^4$ | $2.20 \pm 0.000 \times 10^4$ |
| *Pantoea agglomerans* NY130 | $1.95 \pm 0.009 \times 10^4$ | $2.00 \pm 0.000 \times 10^4$ |
| Leaves (disinfected with ethanol) | 0.00 ± 0.000 | 0.00 ± 0.000 |

±Standard error of the mean (SEM) of three replicates

Example 7: Field Trial for the Management of Fire Blight on *Malus* x *Domestica 'McIntosh' Apple Cultivar Tree Shoots*

A trial was conducted at the IRDA research station in Saint-Bruno-de-Montarville (Québec) to evaluate the effectiveness of selected active strains against shoot blight. One or two shoots were inoculated with *E. amylovora* per tree. Two hours after inoculation, various active strain preparations were applied to the shoots until runoff using a low-pressure atomizer. Five trees were used per treatment, and the experimental design was completely randomized. Formulations based on *P. polymyxa* 273 and *B. velezensis* 50S were prepared as described herein in Example 1.11 ("Formulation of spore-forming bacteria". Those based on *P. poae* FL9F, *P. poae* FL10F, *P. fluorescens* IRDA4, *P. agglomerans* NY60, and *P. agglomerans* NY130 were formulated as described in "Formulation of vegetative bacteria". They were diluted to 20% (v/v) before application. Trees treated with *P. agglomerans* strains NY60 and NY130 had much less fire blight than the control after 10 days, with Disease Scores (DS) not significantly different from those treated with streptomycin. Fire blight never extended beyond the central vein of the inoculated leaf in trees receiving *P. agglomerans* NY60. No evidence of phytotoxicity appeared in either treatment (Table 12).

TABLE 12

Effects of various treatments on McIntosh apple trees experimentally inoculated with *E. amylovora* S435

| Treatment | Median score | Score range | Tukey** |
|---|---|---|---|
| Streptomycin (100 ppm) | 0 | [0, 2] | a |
| Water | 3.5 | [2, 4] | c |
| Sterile culture medium | 3 | [2, 4] | c |
| *P. polymyxa* 273 | 3 | [1, 4] | bc |
| *P. poae* FL10F | 2 | [1, 3] | bc |
| *B. velezensis* FL50S | 3.75 | [3, 4] | c |
| *P. fluorescens* IRDA4 | 3 | [2, 4] | c |
| *P. agglomerans* NY130 | 1 | [0, 3] | ab |
| *P. agglomerans* NY60 | 1 | [0, 1] | ab |

**Values followed by the same letter are not significantly different (P ≤ 0.05) according to lsmeans (Lenth, 2016) with an adjustment for Tukey's HSD to control for family-wise error.

Example 8: Apple Trees Trial to Control Fire Blight on Rome Cultivars in Geneva NY (USA)

A field trial was conducted to determine the performance of the formulated product based on the living cells of *Pseudomonas poae* FL10F (see Example 1.14). This strain was selected to conduct the trial because of its both: 1) strong cell-free supernatant and 2) antagonistic activity against *E. amylovora* strains.

The objective of this trial was to compare the activity of *P. poae* FL with antibiotic (Streptomycin), copper fungicide (Cueva, Certis, USA) and the biological product Blossom Protect based on two strains of *Aureobasidium pullulans* (Porter et al., 1960). Apple trees were infected with 1×10' CFU/mL solution of *Erwinia amylovora*. The concentration of various treatments applied are represented in Table 13. The medium used in Treatment 7 is the same one used to cultivate the *P. poae* FL composed of Nutrient Broth NB (Difco) supplemented with 0.5% (w/w) glycerol and a concentration of 4% NaCl (w/w). Neither the medium nor the treatments used were phytotoxic to apple leaves and no phytotoxicity was noted on the apple trees in this study.

TABLE 13

Performance of the *P. poae* FL10F product compared to antibiotic and copper products

| Trt No. | Treatment Name | Rate | Rate Unit | Fire blight Severity Average length of shoot with symptoms of Fire blight (INCHES) 1 | | Fire blight Incidence Average percentage of shoots with symptons of Fire blight following inoculation % 2 | | Phytotoxicity Percentage of leaves with atypical symptoms % 3 | |
|---|---|---|---|---|---|---|---|---|---|
| 1 | Untreated | | | 6.12 | a | 82.78 | a | 0.00 | a |
| 2 | Strepmycin | 8 | oz wt/a | 3.89 | bc | 52.39 | bc | 0.00 | a |
| 3 | Strepmycin | 2.4 | oz wt/a | 5.53 | ab | 81.73 | a | 0.00 | a |
| 4 | Medium | 20 | % v/v | 6.13 | a | 82.80 | a | 0.00 | a |
| 5 | Cueva | 64 | fl oz/a | 3.90 | bc | 71.14 | ab | 0.00 | a |
| 6 | *P. poae* FL10F | 20 | % v/v | 2.49 | c | 47.70 | c | 0.00 | a |
| 7 | Blossom Protect | 20 | oz wt/a | 3.25 | c | 52.95 | bc | 0.00 | a |
| | LSD (P = .05) | | | 1.403 | | 12.909 | | 0.000 | |
| | Standard Deviation | | | 1.312 | | 12.075 | | 0.000 | |

Means followed by same letter do not significantly differ (P = .05, Student-Newman-Keuls)

The above severe test was conducted in the field to determine if the product based on *Pseudomonas poae* FL10F and its metabolites can control trauma blight which refers to fire blight infection caused when major weather events (i.e., late frost accompanied by hail or high winds) causing injury to the plant tissue. Each treatment was performed on 7 different trees and each tree was 7 feet tall. More than 82% of all cuts with scissors had infection indicating that the infection of the trees was successful. The above results (Table 13) demonstrated that the *P. poae* FL10F product was even more efficacious than antibiotics and copper products.

Example 9: Identification of Active Metabolites in *B. Velezensis* FL50S, *P. poae* FL10F, and *P. agglomerans* NY60

9.1 Materials and Methods

Bacterial Strains and Growth Conditions

The bacterial strains used in this example are as follows: *B. velezensis* strain FL50S was isolated from an agricultural field soil in Wimauma, Fla., USA, *P. poae* FL10F was isolated from strawberry leaves in Dover, Fla., USA, *P. agglomerans* NY60 was isolated from Rome apple leaves in Geneva, N.Y., USA, and *E. amylovora* 5435 was supplied by IRDA, Quebec, Canada). Unless otherwise specified, the bacteria were routinely grown from frozen glycerol stock by culturing in 3 ml tryptic soy broth (TSB) (BD, New Jersey, USA) overnight in test tubes incubated at 30° C. and shaking in a TC-7 roller drum (New Brunswick Scientific Co., New Brunswick, N.J.) at 240 rpm. For inoculation, the appropriate aliquots of each overnight culture were used to inoculate culture media by adjusting the optical density at 600 nm ($OD_{600}$) to 0.01, corresponding to almost $8\times10^6$ CFU/ml.

Production of Secondary Metabolites Produced by *Bacillus* and *Pseudomonas* Isolates The production of metabolites by bacterial isolates was carried out in 2L conical flasks with 500 ml of respective medium. *P. agglomerans* NY60 was cultivated in Difco Nutrient Broth (Becton, Dickinson and Co., Franklin Lanes, N.J., USA) and was incubated for 2 d at 30° C. with agitation at 200 rpm. King's B medium was used as a production medium for *P. poae* FL10F isolate, while Landy medium was used for cultivation of *B. velezensis* FL50S. Cultures were shaken at 30° C. for 48 h at 250 rpm. Landy medium contains: glucose 20 g/L, L-glutamic acid 5.0 g/L, yeast extract 1.0 g/L, $K_2HPO_4$ 1.0 g/L, $MgSO_4$ ($7H_2O$) 0.5 g/L, KCl 0.5 g/L, $CuSO_4$ 1.6 mg/L, $Fe_2(SO_4)_3$ 1.2 mg/L, $MnSO_4$ 0.4 mg/L.

To obtain cell-free supernatants, cultures of both strains were centrifuged at 25 000 rpm for 1 hour. The pellets were discarded and the supernatants were filtered using Stericup™ vacuum filtration system (0.2 μm). Fresh cell-free supernatants were used for the present research, but they could also be stored at +4° C. for one week, or at −20° C. for 6 months, while keeping their activity.

Secondary Metabolite Gene Cluster Prediction and Analysis

Genome mining of biosynthetic gene clusters including non-ribosomal peptide synthetases (NRPSs), polyketide synthases (PKSs), hybrid PKS/NRPS, siderophores, and bacteriocins were predicted with antibiotics & Secondary Metabolite Analysis SHell (anti SMASH) web server version 5 (http://antismash.secondarymetabolites.org/).

Whole-Genome Sequencing

Genomic DNA was isolated from an overnight culture of each strain using a QiagenDNeasy™ blood and tissue kit (Qiagen Inc., Valencia, Calif.). Genome sequencing was performed using Illumina MiSeg™ sequencing system (Illumina, San Diego, Calif.), achieving >50× average genome coverage. De novo assembly was created for each genome using SPAdes 3.0.0 (St. Petersburg genome assembler), and annotated with the NCBI Prokaryotic Genomes Automatic Annotation Pipeline (http://www.ncbi.nlm.nih.gov/genomes/static/Pipeline.html). Taxonomy of each isolate was assigned using Kraken.

Bioassay-Guided Fractionation and Isolation of Active Metabolites

1 L of each bacterial culture was combined, and biomass was removed by centrifugation at 17 700×g for 20 min. The cell-free medium supernatant was applied to 40 g of pre-equilibrated Amberlite™ XAD-16 resin packed in a column. The XAD-16 column was subsequently washed with 1 L of $H_2O$, and then eluted with 1 L of 100% methanol. The methanolic elution was evaporated to dryness by rotary evaporation, and the brown residue was redissolved in 5 ml of purified water (Milli-Q system; Millipore, Bedford, Mass.). The concentrated solution was then applied onto a 12 gram Biotage® SNAP Ultra C18 column to be fractionate using reverse-phase flash chromatography on a Biotage (Stockholm, Sweden) Isorela One instrument. This chromatography was performed using a linear gradient acetonitrile from 5% to 100% over 50 min at 15 ml $min^{-1}$. To identify column fractions containing active compound, each fraction was evaporated to dryness by rotary evaporation and was redissolved in 2 ml of milliQ™ water. The bioactivity of these fractions was further determined by performing agar disc diffusion assay.

Activity of Cell-Free Supernatants and Fractions Against *Erwinia* Amylovora 5435

In order to estimate the activity of bacterial metabolites and fractions against *E. amylovora* S435, agar disc diffusion assay was performed. Paper blank discs (d=6 mm) were saturated by cell-free supernatants or fractions (20 μl), air dried overnight in the biological cabinet at room temperature (22° C.) for 30 min. The antimicrobial activity was then tested by placing saturated disc on a lawn of *E. amylovora* S435 TSB agar plate and measuring the inhibition area ($mm^2$) of pathogen. This assay was performed in triplicate.

LC-ESI-MS/MS Analysis

The cell-free supernatants and active fractions were further analyzed by high-performance liquid chromatography (HPLC; Waters 2795, Mississauga, ON, Canada) equipped with a 250×4.6 mm i.d. Luna Omega Polar C18 reversed-phase column (particle size 3 μm) using a 1% acetic acid—acetonitrile gradient at a flow rate of 500 μl/min. The detector was a quadrupole mass spectrometer (Quattro Premier XE, Waters). Analyses were carried out in the positive electrospray ionization (ESI) mode with a mass window ranging from m/z 130-1930. Collision-induced dissociation (CID) MS/MS experiments were performed using argon gas at various collision energies.

PacBio® Sequencing and Assembly

Single-molecule, real-time sequencing offers longer read lengths making it well-suited for unsolved problems in genome, transcriptome, and epigenetics research. The highly-contiguous sequencing can close gaps in current reference assemblies and characterize structural variation (SV) in genomes.

The resulting assembled sequences were polished with Illumina reads using a combination of BWA version 0.7.17-r1188, SAMtools version 1.9 and Pilon version 1.22. SAMtools version 1.9 and Pilon version 1.22. The sequences of strain *P. agglomerans* NY60 have been deposited in GenBank under the accession number CP034469.

The sequences of strain *P. agglomerans* NY60 were annotated using the DFAST web server and the eggnog-mapper web server. The genes involved in a type VI secretion system (T6SS) were subsequently investigated with Artemis version 17.0.0 and the BLAST suite following the nomenclature of a study describing this system in *Pantoea ananatis*. Finally, a graphical representation of the T6SS loci was made with EasyFig version 2.2.2.

Random Transposon Mutagenesis and Colony Selection

Transposon insertions in *P. agglomerans* NY60 chromosome were generated by mating *P. agglomerans* NY60 with DAP-dependent *E. coli* strain x7213 carrying pUT/mini-Tn5 Sm/Sp on Lysogeny broth (LB) agar supplemented with DAP at 37° C. Mutagenized cells were plated on TSA plates containing spectinomycin (15 μg/ml). The plates were incubated at room temperature (~21° C.) for 2 d. Thereafter, a lawn of streptomycin-resistant *E. amylovora* S435 were spread onto TSA plates. After incubation for another 2 days at 21° C. Bacterial isolates which did not form clear haloes (inhibition zones) on the *E. amylovora* S435 lawns were selected for determination of transposon insertion site.

Identification Transposon Insertions Sites Using Transposon Insertion Sequencing (Tn-Seq)

Genomic DNA of 8 clones was extracted from cultures using phenol-chloroform and pooled together. DNA was sequenced at the Genome Québec Innovation Centre (McGill University, Montreal, QC). DNA concentrations were determined using the Quant-iT™ PicoGreen® dsDNA Assay Kit (Life Technologies). DNA samples were generated using the NEBNext® Ultra™ II DNA Library Prep Kit for Illumina (New England BioLabs) as per the manufacture protocol. TruSeq™ adapters and PCR primers were purchased from IDT. Size selection of libraries containing the desired insert size was obtained using SPRIselect™ beads (Beckman Coulter). Briefly, genomic DNA was fragmented and tagged with adapter sequence via one enzymatic reaction (tagmentation). Thereafter, PCR was used to amplify the region between the end of the insertion (primer TnErwinia-CS1:(5' ACACTGACGACATGGTTCTACAGCGGCCGCACTTGTGTATAA 3' (SEQ ID NO: 174) [transposon-specific sequence is in Bold])), and the Illumina adapter with primer 2 (5' TACGGTAGCAGAGACTTGGTCTCTAGCATAGAGTGCGTAGCTCTGCT 3') (SEQ ID NO: 175) to enrich for transposon insertion sites and allow multiplex sequencing. The thermocycler program was 94° C. for 2 min, 94° C. for 30 s, 55° C. for 30 s 72° C. for 30 s for 33 cycles and 72° C. for 7 min. This region was reamplified to add the Illumina adapters for MiSeg™ sequencing: PE1-CS1 (AGATCGGAAGAGCACACGTCTGAACTCCAGTCACACACTGACGACATGGTTCTACA) (SEQ ID NO: 176) and primer 2. Thereafter, sequencing was performed on an Illumina MiSeq using the MiSeq Reagent Kit v2 Kit (500-cycles). In order to find the transposon insertion sites, reads were mapped to *P. agglomerans* NY60 genome (CP034469.1).

9.2 Results

Genome Mining Studies

Genome mining of biosynthetic gene clusters (BGC) including NRPSs and other secondary metabolites were predicted using antiSMASH 5.0. The summary of the identified secondary metabolites for strains *B. velezensis* FL50S and *P. poae* FL10F are shown in Tables 14 and 15.

For the *B. velezensis* FL50S, through genome mining, a total of 14 putative BGCs were found of which, 8 were identified, including non-ribosomal peptide synthetases (NRPSs) atrributed to biosynthesis of surfactin, iturin and fengycin, and polyketide synthases (PKSs) encoding for difficidin, macrolactin and bacillaene (Table 14).

Interestingly, crude extracellular metabolite studies showed that the polyketide oxydifficidin is the major active metabolite produced by *B. velezensis* FL50S against *E. amylovora* 5435, with this extracellular metabolite fraction producing inhibition halos on a lawn of *E. amylovora* S435 that were comparable in diameter to that of the live strain itself or crude extracellular metabolites therefrom.

TABLE 14

Identified biosynthetic gene cluster regions in the genome of *B. velezensis* FL50S

| Biosynthetic gene cluster type | Most similar known cluster | Similarity | MIBiG BGC-ID |
|---|---|---|---|
| NRPS | Surfactin | 82% | BGC0000433 |
| NRPS, transAT-PKS | Fengycin | 80% | BGC0001095 |
| NRPS, transAT-PKS | Iturin | 88% | BGC0001098 |
| transAT-PKS | Difficidin | 100% | BGC0000176 |
| transAT-PKS | Macrolactin | 100% | BGC0000181 |
| transAT-PKS, NRPS | Bacillaene | 85% | BGC0001089 |
| NRPS | Bacillibactin | 100% | BGC0000309 |
| other | Bacilysin | 100% | BGC0001184 |

For the *pseudomonas* sp. FL10F, a total of 5 NRPSs gene clusters were identified. Among them, two unlinked NRPS gene clusters with 100% similarity to gene clusters coding for NRPS responsible for biosynthesis of cyclic lipopeptide (CLP) Poaeamide were identified. Crude extracellular metabolite studies showed that the cyclic lipopeptide white line-inducing principle (WLIP), a cyclic lipopeptide from Viscosin subfamily (Massetolide E, F, L or Viscosin), is the major active metabolite produced by *P. poae* FL10F against *E. amylovora* S435, with this extracellular metabolite fraction producing inhibition halos on a lawn of *E. amylovora* S435 that were comparable in diameter to that of the live strain itself or crude extracellular metabolites therefrom.

TABLE 15

Identified biosynthetic gene cluster regions in the genome of *P. poae* FL10F

| Biosynthetic gene cluster type | Most similar known cluster | Similarity | MIBiG BGC-ID |
|---|---|---|---|
| NRPS-like | Mangotoxin | 71% | BGC0000387 |
| NRPS | Poaeamide | 100% | BGC0001208 |
| NRPS | Pyochelin | 100% | BGC0000412 |
| NRPS | Poaeamide | 100% | BGC0001208 |
| NRPS | Safracin | 100% | BGC0000421 |

Mass Spectrometry Identification of Metabolites

Figure 4A:
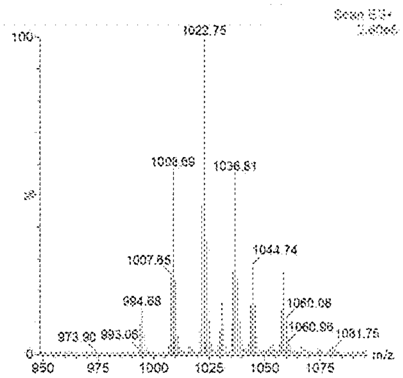
FIGS. 4A-4C show MS spectra of three families of cyclic lipopeptides produced by *B. velezensis* FL50S.
Figure 4B:
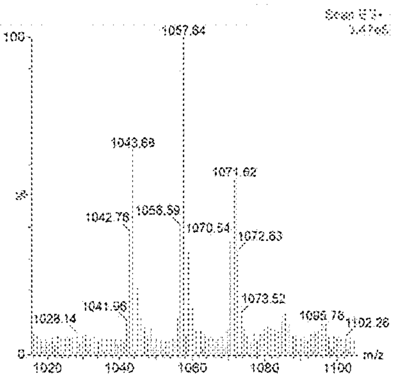
Figure 4C:
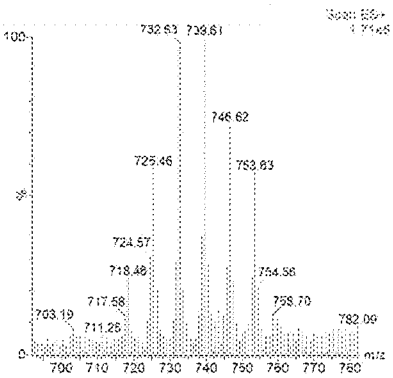
Figure 5:
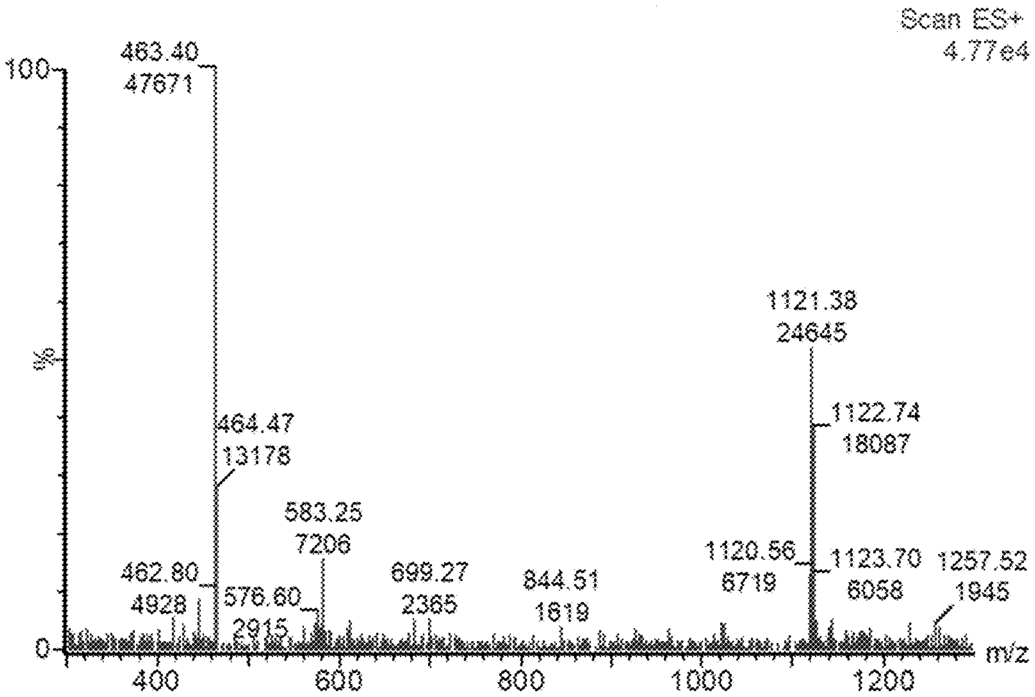
FIG. 5 shows MS spectra of produced oxydifficidin in supernatant of *Bacillus velezensis* FL50S culture detected in positive ionization mode.

The antiSMASH results suggest that *B. velezensis* FL50S has the biosynthetic machinery for the production of three classes of cyclic lipopetides as well as three polyketides. To verify the antiSMASH results and see if these gene clusters are functional, cell-free supernatant of *B. velezensis* FL50S was analysed by HPLC-ESI MS. In accordance with antiSMASH results, MS spectra of *B. velezensis* FL50S indicated that it produces three families of cyclic lipopeptides, surfactins, iturins and fengycins (FIG. 4). Regarding polyketides, only the oxidized form of difficidin, oxydifficidin, could be detected (FIG. 5). Performing the HPLC-ESI MS analyses on fractions obtained from activity guided fractionation of the crude extracellular metabolite showed that the polyketide, oxydifficidin, is the major active metabolite against *E. amylovora* S435. While it is reported that difficidin and oxydifficidin can only be detected in their deprotonated forms ($[M-H]^-$=543.4 and 559.3) in the negative ionization mode, in positive mode, oxydifficidin could be detected in its dephosphorylated (m/z 463.4) and dimmer (m/z 1121.3) states.

Figure 6:
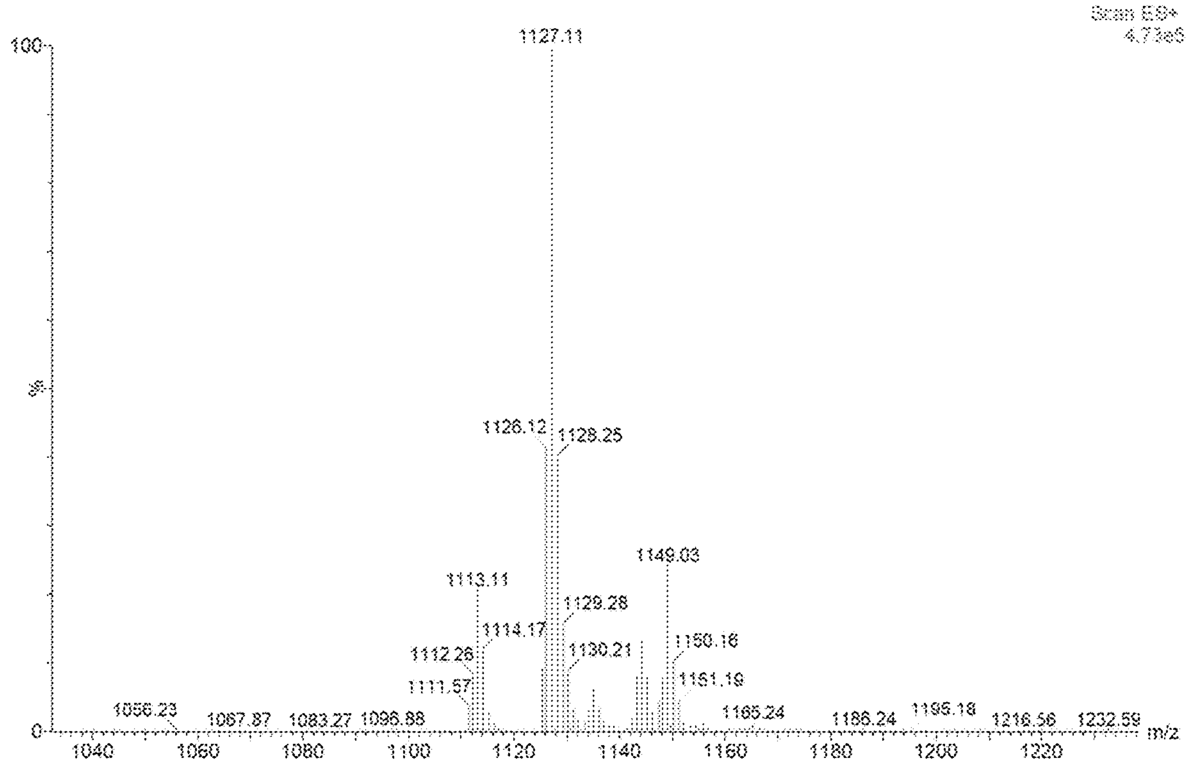
FIG. 6 shows MS spectra of fraction of *P. poae* FL active against *E. amylovora* S435.
Figure 7A:
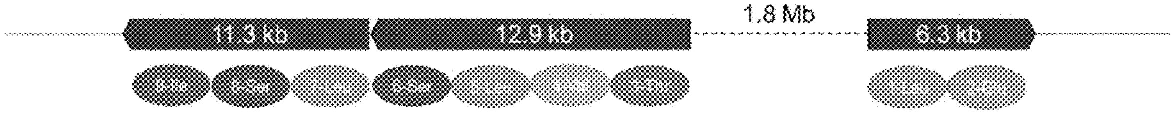
FIG. 7A shows organization of cyclic lipopeptide (CLP) biosynthetic gene clusters of *Pseudomonas poae* FL10F as identified by antiSMASH.
Figure 7B:
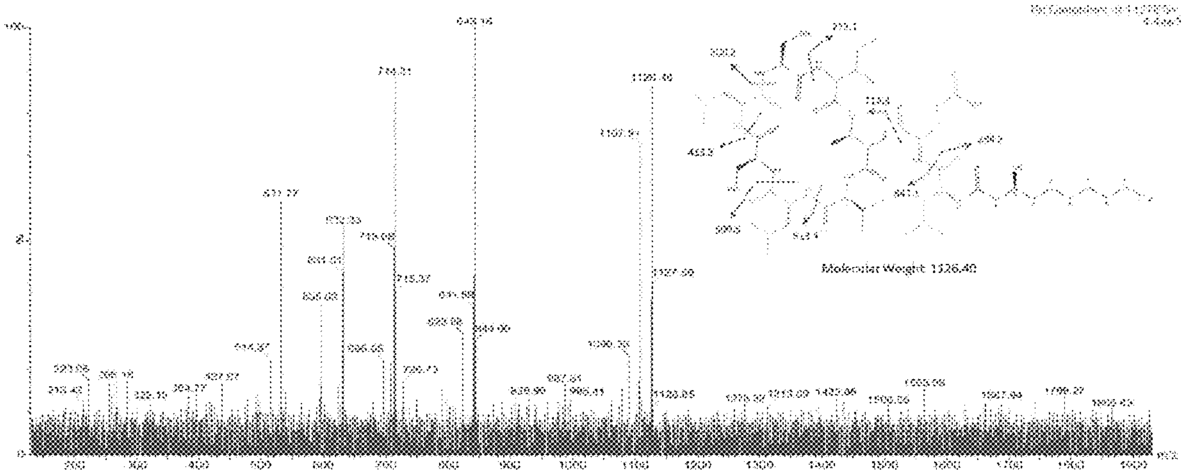
FIG. 7B shows MS/MS fragmentation spectrum of parent ion peak 1127.3 (m/z) at different collision energies in positive ionization mode. The daughter ion peaks are indicated on the proposed structure.
Figure 8:
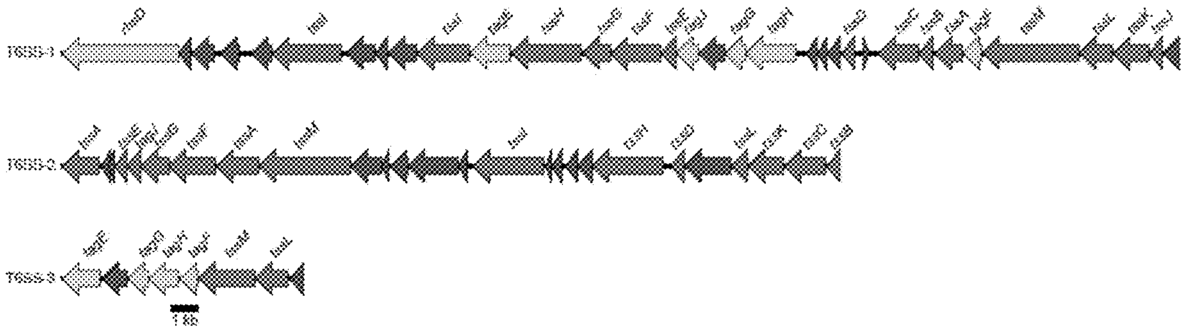
FIG. 8 shows schematic representation of the three loci with genes encoding proteins involved in T6SS found in strain *P. agglomerans* NY60. The red, green, and blue arrows represent the core, accessory, and other genes, respectively.

Analysis of the MS spectra of the active fraction of *P. poae* FL10F against *E. amylovora* S435 showed the presence of a major pseudomolecular ion peak at m/z 1127.1 and some minor peaks including 1113.1 $[M+H]^+$ with a 14 unit mass difference with the major peak (FIG. 6). Collision induced dissociation tandem MS/MS of the major pseudomolecular ion peak at m/z 1127.1, combined with antiSMASH amino acid sequence prediction of the putative product of two unlinked gene clusters coding for the cyclic lipopeptide poaeamide, suggest that 1127.1 peak could be attributed to white-line-inducing principle (WLIP), a cyclic lipopeptides from Viscosin subfamily (Massetolide E, F, L or Viscosin) (FIG. 7).

Screening for Transposon Mutants of *P. agglomerans* NY60 with Decreased Antagonist Activity Against *E. amylovora* S435

Regarding the *P. agglomerans* NY60 strain, while its cell free supernatant from nutrient broth culture showed no activity against *E. amylovora* S435, it was still able to produce an inhibition zone on lawn of *E. amylovora* S435 on TSA agar plates. This suggest that the metabolites can only be produced on solid agar medium. In order to identify the active metabolites, random transposon mutants of *P. agglomerans* NY60 were generated using mini-Tn5 Sp/Sm transposon and screened on TSA plates against streptomycin resistant *E. amylovora* S435. Transposon-generated mutants of *P. agglomerans* NY60 were screened and 8 mutants that has lost their antagonistic activity were obtained. Using transposon insertion sequencing (Tn-seq), the insertion sites in these were mapped and lead to the identification of few genes that significantly altered the production of antagonistic metabolites (Table 16).

TABLE 16

Identified transposon insertion sites in the genome of *P. agglomerans* NY60

| Insertion site | Locus tag/Gene product description |
|---|---|
| CP034469 | — |
| 474908-474967 | TonB-dependent siderophore receptor CDS |
| 569998-570191 | dndD CDS |
| 1416125-1416319 | glycosyltransferase CDS |
| 1526586-1526815 | flgL CDS |
| 4028399-4028630 | 16S rRNA |
| plasmid CP034471 | — |
| 97482-97585 | MFS transporter CDS |

Genomes of *P. agglomerans* NY60 and NY130, *P. poae* FL10F, and *B. velezensis* FL50S were determined by whole genome sequencing (Table 17).

TABLE 17

Whole genome sequencing of *P. agglomerans* NY60 and NY130, *P. poae* FL10F, and *B. velezensis* FL50S

| Strain | Genome | SEQ ID NO: |
|---|---|---|
| *P. agglomerans* | Chromosome | 14 |
| NY60 | Plasmids | 15-18 |
| *P. agglomerans* | Chromosome | 19 |
| NY130 | Plasmids | 20-23 |
| *P. poae* FL10F | Contig sequences | 24-103 |
| *B. velezensis* FL50S | Contig sequences | 104-173 |

9.2 Conclusions

*B. velezensis* FL50S

In accordance with antiSMASH results, MS spectra of *B. velezensis* FL50S indicated that it produces three families of cyclic lipopeptides, surfactins, iturins and fengycins (FIG. 4). Regarding polyketides, only the oxidized form of difficidin, oxydifficidin, could be detected (FIG. 5). Performing the HPLC-ESI MS analyses on fractions obtained from activity guided fractionation of the crude extracellular metabolite showed that the polyketide, oxydifficidin, is the major active metabolite against *E. amylovora* S435. While it is reported that difficidin and oxydifficidin can only be detected in their deprotonated forms ($[M-H]^-$=543.4 and 559.3) in the negative ionization mode, in positive mode, oxydifficidin could be detected in its dephosphorylated (m/z 463.4) and dimmer (m/z 1121.3) species.

*P. poae* FL10F

Our results demonstrate that *P. poae* FL10F produce an active extracellular compound against *E. amylovora* 5435 that can be attributed to a cyclic lipopeptide, white line-inducing principle (WLIP), a CLP from the Viscosin subfamily (Massetolide E, F, L or Viscosin).

It is interesting to note that by indexing the *Pseudomonas* specialized metabolome, in the literature, the molecular-networking-based discovery of four molecules and their evolutionary relationships were reported: a poaeamide analogue and a molecular subfamily of cyclic lipopeptides, bananamides 1, 2 and 3. Analysis of their biosynthetic gene cluster showed that it constitutes a distinct evolutionary branch of the *Pseudomonas* cyclic lipopeptides.

*P. agglomerans* NY60

The strain *P. agglomerans* NY60 had a direct cell-to-cell antagonistic effect against *E. amylovora* S435. The whole genome was sequenced by SMRT PacBio and three loci with genes known to be involved in T6SS were found. Two of the three loci include all the core genes needed to form a functional system, in addition to a few accessory genes. The third locus only harbor two core genes and is likely the remnant of an ancient T6SS locus. It is interesting to note that the three loci have important structural similarities with the T6SS-1, T6SS-2 and T6SS-3 loci found in the bacterium *P. ananatis*. However, the T6SS-2 locus is known to be plasmid-borne in *P. ananatis* while it is located on the chromosome in strain *P. agglomerans* NY60.

By screening for transposon mutants of *P. agglomerans* NY60 with decreased antagonist activity against *E. amylovora* S435, it was interestingly discovered, one of the transposons is inserted in MFS transporter gene. BLASTing the sequence indicated that it matches the sequence for EhpJ gene in *Pantoea agglomerans* (*Erwinia herbicola*) Eh1087 which is a transmembrane protein predicted to be involved in the extra cytoplasmic localization of griseoluteic acid, an intermediate in biosynthesis of broad-spectrum phenazine antibiotic D-alanylgriseoluteic acid (AGA).

Although the present invention has been described herein by way of specific embodiments thereof, it can be modified without departing from the spirit and nature of the subject invention as defined in the appended claims. The scope of the claims should not be limited by the preferred embodiments set forth in the examples but should be given the broadest interpretation consistent with the description as a whole.

REFERENCES

Fromin, N., et al., The genotypic diversity of *Pseudomonas brassicacearum* populations isolated from roots of *Arabidopsis thaliana*: influence of plant genotype. *FEMS Microbiology Ecology,* 2001. 37(1): p. 21-29.

Granatstein, D., Alternative Fire Blight Control Materials to Replace Antibiotics. 2011*, Organic Tree Fruit Industry Work Group.*

Henry D A, C. M., LiPuma J J, Speert D P., Identification of *Burkholderia cepacia* isolates from patients with cystic fibrosis and use of a simple new selective medium. *Journal of Clinical Microbiology* 1997. 35(3): p. 614-619.

Kim, I. Y., et al., Controlled release of *Pantoea agglomerans* E325 for biocontrol of fire blight disease of apple. *J Control Release,* 2012. 161(1): p. 109-15.

Lenth, R. V., Least-Squares Means: The R Package lsmeans. *Journal of Statistical Software* 2016. 69: p. 1-33.

Porter, J. N., J. J. Wilhelm, and H. D. Tresner, Method for the preferential isolation of Actinomycetes from soils. *Appl Microbiol,* 1960. 8: p. 174-8.

Pusey, P. L., et al., Antibiosis activity of *Pantoea agglomerans* biocontrol strain E325 against *Erwinia amylovora* on apple flower stigmas. *Phytopathology,* 2011. 101(10): p. 1234-41.

Smits, T. H., et al., Metabolic versatility and antibacterial metabolite biosynthesis are distinguishing genomic features of the fire blight antagonist *Pantoea vagans* C9-1. *PLoS One,* 2011. 6(7): p. e22247.

Stockwell, V. O., et al., Control of fire blight by *Pseudomonas fluorescens* A506 and *Pantoea vagans* C9-1 applied as single strains and mixed inocula. *Phytopathology,* 2010. 100(12): p. 1330-9.

All references mentioned in the present document are hereby incorporated herein by reference.

SEQUENCE LISTING (176 sequences)

SEQ ID NO: 1 - DNA, 23 bp, Artificial sequence
  rpoB-f primer
aggtcaactagttcagtatggac

SEQ ID NO: 2 - DNA, 21 bp, Artificial sequence
  rpoB-r primer
aagaaccgtaaccggcaactt

SEQ ID NO: 3 - DNA, 18 bp, Artificial sequence
  rpoB1698f primer
aacatcggtttgatcaac

SEQ ID NO: 4 - DNA, 20 bp, Artificial sequence
  rpoB2041r primer
cgttgcatgttggtacccat

SEQ ID NO: 5 - DNA, 24 bp, Artificial sequence
  gyrA-f primer
cagtcaggaaatgcgtacgtcctt

SEQ ID NO: 6 - DNA, 24 bp, Artificial sequence
  gyrA-r primer
caaggtaatgctccaggcattgct

SEQ ID NO: 7 - DNA, 41 bp, Artificial Sequence
  UP-1 primer
  misc_feature (1)..(41): n is a, c, t, or g
  misc_feature (1)..(41): r is a or g
  misc_feature (1)..(41): y is c or t
gaagtcatcatgaccgttctgcaygcnggnggnaarttyga

SEQ ID NO: 8 - DNA, 44 bp, Artificial sequence
  UP-2r primer
  misc_feature (1)..(44): n is a, c, g, or t
  misc_feature (1)..(44): r is a or g
agcagggtacggatgtgcgagccrtcnacrtcngcrtcngtcat

SEQ ID NO: 9 - DNA, 23 bp, Artificial sequence
  UP-1S primer
gaagtcatcatgaccgttctgca

SEQ ID NO: 10 - DNA, 23 bp, Artificial sequence
  UP-2Sr primer
agcagggtacggatgtgcgagcc

SEQ ID NO: 11 - DNA, 23 bp, Artificial sequence
  T7 primer
ttgtaatacgactcactataggg

SEQ ID NO: 12 - DNA, 20 bp, Artificial sequence
  pA-27f-YM primer
  misc_feature (1)..(20): m is a or c
  misc_feature (1)..(20): y is c or t
agagtttgatymtggctcag

SEQ ID NO: 13 - DNA, 20 bp, Artificial sequence
  pH primer
  misc_feature (1)..(20): r is a or g
aaggaggtgatccarccgca

SEQ ID NO: 14 - DNA, 4049378 bp, Pantoea agglomerans NY60 (residues 1-2,024,689 of 4,049,378)
tgaccgatgttcatacgcgatggtacgcccagcgggttcagaacgatgtcaaccggcgtgccgttttcatcgtaaggcatatcttcgatcgggttgatcttagagataacacctttgttaccgtgacggcctgccattttgtcacccggctgaatctgacgcttaacagccagataaaccttaacgattttcagcacgcctggtgccagatcatcgccctgggtgattttacgacgcttaccttcgagttttttctcaaactcgtgcttcagctcgtcgtactgctctgccagctgctccagctggttttgcttggcttcgtcagtcagacccagttccagccagcgctcgcgcggcagcttgtccagtttgtctgcttcaacgccaccagaaatcaatacgttctggatacggctgaacaggcccgcttccagaatctgcagttcttcagacaggtctttcttggcctgcttcagctgcatctcttcaatttccagcgcacgtttgtctttttccacgccatcgcgggtaaagacctgaacgtcgatcacggtgcctgacacgccattcggtacgcgcagtgacgaatctttcacgtcagaggctttttcaccgaagatagcgcgcagcagtttctcttctggcgtcagctgggtttcacctttcggcgtaaccttaccaaccagaatgtcgccaccggtcacttcagcaccgatgtagacgatgcctgactcatccagtttagagagtgcagcttcacccacgttcgggatatcagcggtaatctcttccggccccagtttggtgtcacgcgacacgcaagccagttcctgaatgtggatagtcgtaaagcgatcttcctgaaccacacgctcggagaccaggatggagtcttcgaagttgtaaccgttccacggcatgaacgctacgcgcatgttctggcccagtgccagttcacccagatcggtggacgggccatctgccagcacgtcgccgcgctcaaccggctcacccagagaaacacatggcatctggttgatgcaggtgttctggttagaacgggtatatttggtcaggttatagatgtcgataccggcttcgccagcatgcatttcgtcttcgttaactttgataacgatacgtgatgcgtcgacgtactgtacggtaccgccacgtttggcaacggcagttacaccggagtcaacggcaacagcacgttccatacccgtaccaaccagcggcttatcagcacgcagagtcggaacggcctgacgttgcatgttcgcacccatcagggcgcggttagcatcatcgtgttccaggaacgggatcagggacgcaccgacagaaacgatctgttgagtcgaaacgtccatgtagtcaacctgatcgcggctgaacagacttgattcgcctttgctacggcaggtgaccaggtcatcaacaaacgcgccgttatcatcaagaggggcgttcgcctgagcgataacgtagttaccctcttcgatagcagagaggtagtgaatctcgtcagaaaccagaccgtcgataacacggcggtaaggcgtctcaaggaaaccgtactcgttggtctgtgcatacacagacaaggagttgatcagaccgatgttcgggccttcaggggtttcgattgggcagacacgaccgtagtgcgttgggtgtacgtcacgcacttcgaagccggcacgctcacgcgtcaaaccacccgggccgagagcagagatacgacgtttgtgcgtaatctctgacagcgggttgttctgatccataaactgagaaagctggctggaaccaaagaactctttcaccgcggccgaaattggcttcgcgttgatcatgtcctgtggcatcagggtatcaaggtcgcccagtgacagacgctctttcaccgcacgctcaacacgtaccagaccgacacggaactggttctcagccatttcaccgactgaacgaatacgacggttaccgaggtggtcaatatcgtccacttcgcctttaccgttacggatgtcgatcagcttcttcatcacttcgatgatgtcatctttgctcaggatgcctgaaccttcgatttcatcacgcagcaatgaacggttgaacttcatacgacccacagcagaaagatcgtaacgatcttcagagaagaacaggttctcaaacaggttctctgctgcttcgcgtgttggcggctcaccaggacgcatcatgcggtagatctcaaccagtgcgctcagacgatcgctggttgggtcgacacgcagggtctcggacatatatggaccgtggtccagatcgttggtgaacagcgtttcgatgcgcttgtgaccggactggctcagtttggccagcagatccagtgacagttccatgttcgctgcaatgatcagctcaccggtgctctcatcgatgtagtctttagcgaccactttgcccgcgatatattcaaccggaacttcgatgtgctgaatgccatctttttccagctgacggatatggcgcgcagtaatacggcgtgctttttcgacgtagacggtgccgtttcgcttcgatatcgaaggtcgcagtttcaccgcgcaggcgctcaggcaccagctccatctgcagcttgttgtcgcgaatttcaaacaccactttctcgaagaagatatcgagaatctgaggtgtagtgaactgcaacgcacgcaggatgatagtggccggcagcttacgacgacggtcaatacggacaaacaggttatctttcgggtcaaactcaaagtcgagccatgaaccgcggtaagggatgatacgtgcgttgtagagcactttacccgatgagtgggttttacccttatcgctatcaaagaacacgccaggactacggtgcagctgagaaacgataacgcgctcggtaccattgataacaaaggtaccattgtcggtcatgagcggaatttcgcccatgtagacttcttgttctttaatgtcttttacggtgccttctggcgcttcgcgctcatagaccaccagacgcagtttcacgcgcagcggtgccgaataggtcacgccacggatctgacactctttcacgtcaaagacaggttcacccaggcgatagctgacatactgcaactcagagttgccgctgtagctcgcaatagggaatacagagcggaatgcagcttccagtccgtactgaccttctggatcttgctcgataaacttctggaacgagtcgagctggatggaaaggagataaggtatgtccagtacttgcggacgtttaccaaaatccttacgaatacgttttttctcggtataggagtaaaccatagggttcctcagctagctgacaagtcgacccacgctgtccgtcctgacaggacagttcatgcaacacgattttgtttgattcactggctgcgcagcagcagtgcaatacctctttctatcacgcttaaatcatttcatcgctgttgcgagggcagggaaacccgcacaggtagagcggtatattaagtcgtcgatagagaaagatattgaagagtaacaatggacaaacagtgtgaaaccccattgagaccctgtagcgcaaaaaggctggtgaccaaaaagtcaccagccatcagcctgaaactactcagactgcaacccgaaggctgtcttacttaacttcaacttcagcgccagcttctttcagagcagcttcaagtgcagctgcgtcatctttgctgatcgcttctttgattacgccagttgcttcaaccagatctttggcttctttcaggcccagaccagttgcagtacgtacggctttgattactgcaaccttgttcgggccaacagctttcaggactacgtcgaattcagttttttcttcaacagcttcagccgggcccgcagcaacagctacagcagcagcagcagaaacgccgaatttttcttccatagcagaaaccagctcaactacttccattacggacatcgctgcaacagcttccagaatttggtctttagtaatagacatgacaattgttcctaagaatcagaaaaagtttatacgtaagcaagtacgaagaaaagaatatggccttaagccgcttcttttgcatcgcgtacagcagccagagtgcggaccagtttgccggcagcggcttctttcatggtcgacatcagacgtgccagtgcttcttcgtaggtcggcagcgttgccagacggtcaatattggccgccgtgatcagctcaccttcaaaggctgcagctttgacctcaaattttgcattcgctttcgcgaaatctttgaacagacgagcagcagcgcccgggtgttccatagaatatgcaatcagggtcggaccaacaaacgtgtctttcaggcactcaaactgagttccttcaacgacgcggcgcagcagggtgttacgaacaacacgcatgtaaacgccagcttcacggcctgctttacgcagttcggtcattttatcaacggtaacgccacgggaatccgcaacaaccgctgaaagcgcacctttggctacttcgctgacttcagcaacaatcgcttgtttgtcttgaagatttaatgccattagcttttgctcctggatttgaccgggaaaggatttccccggaactcacttcacttactcaccccaaggggaaataagcgctcgaacacggtgagcagaatccagctaagaaaaaattcttttggttctgtcaccgtctacgcagggtattaagcggaatatccggagataagcagctcctgcggtcttggacggaggccaggataaggcctggctccaacctaaattctgtgcgacgcagcagagtcagagggaaaggcgatacacgcaacaatcagtttctggctctctggtgtcctgttccgttaataacagaacaacgggcgtaagattctaggtgaatttttcgcccgtttcaagcagcaattagtttgctgttgcgttcagaccagcctggtcaacggcaacgccggcgcccatggtggttgaaaggctaactttcttgatgtacacgcctttcgcctgagatggttttgcttttttcagcgcaaccagcagagattccaggttttctttcagtttgtcagcgtcaaagtccactttaccgatggtagtgtggatgatgccgtttttgtcgttacgataacgaacctgacccgctttagcgttcttaaccgcttcagcaacgttaggcgttacagtaccgactttcgggtttggcatcaggccacgtggacccagaatctggcccagctggccaacaacgcgcattgcatccggagaagcaataacaacgtcaaaattcatttcgcctttcttgatctgatcagccaggtcttccatgcctaccagctcagcgcctgctgctttagcagcttcagcgttggcgccctgggcgaagacagcaacacgtactgaacgaccagtaccgtgtggcagaacggtcgcgccgcgaacgttctgatcagatttacgtgcatcaatgccgaggttgacagcaacgtcaacgctttcaacgaacttggcagtagccagttctttcagcagagcaacagcttcagcaatatcatactgcttggtcgcgtcaactttgtcgcgaattacggtcatgcgcttggtcagcttagccatttcttagtcctctactaccaggcccatggaaacgagcagtaccttcgatggagcgagtcatcgcttcaacgtcagaaccagtcatgtccgcagctttggtttctgcgatttcacgtacctgagcacgagtcactttaccgactttatctttgttcggcttaccagaaccagacttgatgcccgctgcttttttcagcagtacggcagccggaggcgttttggtaatgaaggtaaaagaacggtcgctgtatacggtgataacaacaggagtcggcagacctttttccagagattcggtcttagcgttgaacgctttgcagaattccatgatgttaacaccctgctgacccagagctggaccaaccggtggacttgggttcgccataccagctgcaacctgcagcttgacgtaggcttggactttcttagccatgatatttcctcaattgggttatagcgcctgtaaaggctccccgtgataacgatttacacgctgttgccagcgcataaaaacaaaaggcgcgaaattgtagttaaatttcgcgcctgctgcaacagctaatttgtgagcggaaagaggttaacctttctccacctgaccgaagtcgagctcaaccggcgtcgcacgtccaaagatggaaacggataccgtcaggcggctcttctcgtaatccacatcttcaaccacaccgttaaagtcagcaaaaggaccgtcattaacgcgaaccatttcacctggctcaaacagcgttttcggacgaggcttgtcgccgacctgctgcagacggttcatgatcgcatcaacttctttatcgctgataggtgccggacggtcagatgtaccgccgatgaaacccatcacgcgtgggacgctgcgtaccaggtgccagctggcgtcattcatcaccatctgaaccagtacgtatcccgggaaaaacttgcgctcgctcttacgacgctggccaccacgaatttcaacgacttcttcagtcggaaaccatgacgtcgccaaacagctcttccatgttgtgcaatttgatatgctcgcgcagcgattgtgctacgcggccttcaaaaccggaaaacgcctgtacgacgtaccagcgtttctttggagcttcagacatctcagaacctcaggccagtgataaacgataccagacggaccagaataccatccagcccccacaaaatcagtgacatcacggcagtaaccgcggcaacgattaacgtggtgtgcagcgtttcctggcgggttggccagataaccttacgcatttctgttcttgcttcacgagcaaaagccacggtcgctttgcctttggtcgttaaaagcgcaatgccgccagccgctgcaatcagtacaactacggctaaagcacgcagtggcagtgacacatcacgatagaggtagttacctacaatcgctgcaagcagcagtaatacgactactacccactttaccgcttccaggccacgcccgctcccttgagcttcggtattcgcactcataaaccaacctgccacaataattcagaaactattctgccccgcagtgcgaggcgtccaaaccgaatgagcttttggggcgtaactcggtatccaacgccgcataacagagcctgtctcagcaatgattatgattcaaaaaatcactgatgagccaggttctatgaaacagcgtgcaaaaagggcatcaaatgatgccctttccgtgtgcattgcgtcaaacgttatcggtaattatgcgataactttagcaacaacacccgcgccaacggtacggccaccttcgcggattgcgaaacgcagaccttcgtccattgcgattgggtgaatcagggtaacaaccattttgatgttgtcgcctggcatgaccatctcaacgccttctggcagctctactgaaccggttacgtcagttgtacggaagtagaactgtggacgatagcctttgaagaacggagtatggcggccaccttcgtctttagacagaacgtaaacttctgactcgaactgggtgtgcggcttgattgagcctggcttagccagaacctggccacgctggatgtcttcacgcttgataccgcgcagcagaacaccacagttttcgcctgcctgaccctggtccagcagcttacggaacatctcaacaccggtacaggttgatttcgcagtatctttgatacccacgatttcaacttcgtcgccgactttaacgatgccgcgctcaacacgaccggtaacaacggtaccacggccagagattgagaatacgtcttcgattggcagcaggaacggcatgtcgatcgcacggactggatccgggatgtagttgtccaggtgttcagccagctcaacgatttttgcttcccactcaggaacgccttccagcgctttcagagcagaaccacgaacgatcggggtgtcatcgcctgggaagtcgtactgtgacagcaggtcacgaacttccatctctaccagttccagcagctcttcatcatcaaccatgtcacacttgttcaggaacacgatgatgtaaggaacgccaacctgacgacccagcaggatgtgctcacgggtctgtggcattgggccatcagtcgcagcaacaaccaggatcgcgccgtccatctgcgcagcaccggtgatcatgtttttcacatagtcggcgtggcctgggcagtcaacgtgagcgtagtgacgtgcagcagtctcatactcaacgtgtgcggtgttgatggtgataccgcgggctttttcttcaggcgtgctgtcgatctgatcgaatgcacgagcctggccgccgttggttttagccagtacggtagtgatagctgcagtcagggtggttttaccgtggtcaacgtgaccgatggtgcccacgtttacgtgcagtttgttacgttgaaattgctctttagccatcgctagtccctctaagacacggatatatcaatgatatcatcacattaaccaggcaatgcctgactgcaaggaagttacagagaaaatcaggagggagattaaaggaagtggtgctgatacccagagtcgaactggggacctcacccttaccaagggtgcgctctaccaactgagccatatcagcacatctggagcgggcagcgggaatcgaacccgcatcatcagcttggaaggctgaggtaatagccattatacgatgcccgcatcctggaactcggctacctgttctttctgtagcttgcagataacagagatgtttctctactatctactgcctgtcagcgaagctgaccgactttgacttcgctaacgctcagtctgaattcagggtgataagtgactcacctgacagataaacaggttgtttatctgtgttcccaaccgcgaggttgagatggtggtgggagaaggattcgaaccttcgaagtctgtgacggcagatttacagtctgctccctttggccgctcgggaatcccacctacttgatggtgccggctaccggaatcgaactggtgacctactgattacaagtcagttgctctaccaactgagctaagccggcatcaagtggagcgcattctaggaaggtcgggctctggatgcaactaaaaaatcgcttatttttttctatcgcttactatttgtgcaaatcatcgcattttagtgtttttgtgcagaatatttgtgcaatctagtcctgttttcataggatcagtcggctcgcgctaatgccttaggcctctctctggaccgcttttcagcaggtaaatgatctgcagggagtatttttatttcacacgcctgtaccgaacgatgcttttttgacctcgcctgcgcttttttttcatgtgcaggcacttttctgtagaaaccaggcctgttttgacatgcgtgtcccttatgtcggtacgacgatgaccaggcgtggagcctttcaaaatgactctatgctgttgtttcgtttgctgaagtccttatgggacatattgaatctgtaccgcctcagcctctctatatgcccttatggcggcgttttgtcattcagacgttgtcagatgtaaaaagcagataaaagccgcacatgcgctgtgatgtcctgcaatatcataaacaacgataaagcagtaaaaattaaagccaccatgatgttttgtgggtatgccgacgaaagcgagatcacgtttatctttttacttctgttaaaagccatactggtgataccctccagcccattgttctcactgataaaccagcgattcgtgattcacttcacctgtgctgtcctgcttatcggataacacgcggttgatagccatgaatttgcggtcagatgcatgcttatggataaaacgacccccctgacaacgccttatttagagttcactcgtgagcaatgggctgcattacgtgattccgtacctatgacgctgtcagaggaagagatcgcgcagctggagggcatcaacgaggatctctcgctggaggaagtagcggaaatttatctgccactttcacgcctgcttaatttttatataagttctaacgttcgccggcaggctgtactggagcaatttctgggcaccaatggccagaaaatcccctatatcattagtattgcgggtagcgtagcggtcggtaaaagcacgactgcgcgtgtcttgcaggctttgctcagccgctggcctgaacatcgcaaagtcgaattgatcaccactgatggcttccttcatcctaatgccgtgctgaaagagcgtgggttaatgaagaaaaaaggattcccgcaatcctacgatatgcaccggttggtcaatttcgtctccgatttgaagtcgggagccagtcaggttactgctccggtctattcacatctgatttatgatgtcatccctgatggcgataaagtgatacagcagccagatattctgattctggaaggactgaatgtattacagagtggaatggactatccccacgatccccatcatgtctttgtttcagatttcgtcgatttttctatctatgttgatgcagaggaagatctcctgcaaagctggtatatcaatcgattcctgaaattccgccagggcgcatttaccaatccggactcctatttccatcattacgcccagctttcagaagcagaagcggttgaaattgctggtaatttgtggaaagagattaactggcttaacctgcaggaaaatatcctgccgacgcgcgaaacgagccagcctgattatgaccaaaagtggcgatcatgcagtcgataaggttcgcttgcgtaaataactgctgtcataaaaaagcctgcgctgctgcaggctttttttactcagacaggacgcagtgatatttctccacccacccaggcttttatttcgccatcctgttccagtaacaggccaccctggctgtctacgcctcgcgcaataccatggacctcacgttcaccgataagcagcttaaccggccggttaataaagttatccagcgcagcccagcgtgcgacaaacggggttaatccctcctgctcaaagagcggcagagcttcgcgcagactgttgatcagacgtgccgcaagctcattgcggtttaccgttaccccggcctcctgcaggttaatccagccctgattaatctgtgatgcatcggctgttcgcatcgccaggttaatccccgcaccaatcacgatctgcgcagcatcgccggttttacctgtcagttcgaccagaatacccgccagtttacgatcgttcaggtaaatatcattgggccattttacgcggacatcatcggcccctaatgaacgtaatgtctcagccatgataatgccaattaccaggctcagacccatcgccgctgccggcccctgctccagacgccagtacatagacatgtagaggtttgcgccaaagggcgaaaaccactgacggccacgacggccgcgacccgcctgctgatattccgcaatgcaggcagcacccgactccatttcatgcatacgttccagcagatactgatttgtggaatcaatcaccgggattaccgagacgttaccctgcgtaacctgtgagagtatcgcctgctcatccagcagctgtatcggggcagagagactgtaacctttgcctgtcacggtatagacatcaagaccccagctttttaacgtctggatatgcttatttatggctgcgcgactcatgcccagcgtttcacccaactgctcaccggaatggaactcaccatcagataagatatcaaccagctttagcggaacattatggtctttcatgcgatcaccccgacggcattacactcaccctgcgcctgaataaagcgcacttcgggttcaagccagacatcgaatttttcaccaacctgagcgcgcacggtttttgccagcgcaacgatatcgtcgggagtggcattttcagcgttgatcagcaccagagcctgttgctggtgaactgccgcgcccccgatgcgataacctttcagctggcactgatcgataagccatcctgctgccagtttgatttcaccatttggcatcagatagtgtggcatagccggaaaatgcgttagtagtgagctgcactgcgcctcggtgacgacaggatttttaaaaaagctgcctacattaccggtgactttcggatcgggtaatttgctctgccgcatctggcataccgcgtgatagacatcccaggcattggccgtcaccggattgagcgttttcagatcgccgtaggttaataccggttgccattgcttaggcaatattatcccgactgcgacgatgacatagcctgactggtagtgatgtttaaaaatgctgtcacgatagccaaactcacaggcttcacgatcgagacgtttctgtctgaccactgtgcagattaagtacatccacgtattcgcagacgtcttttaattccacgccataagcacctatgttctgaatcggtgccgaaccggtcataccagggatcaacgccagattttccaggcctgtgattcctttttccagcgtgcttttaaccagctgatgccagttctcacctgccccaacgtgcaatttccagcgctcatattcatcctgaattttgatgcctttgatgcggttcagcaccactgtaccggcaaaatcttccaggaagaggacattgctgccttcaccgagcacaaggaaaggcgtttgatcactctggctggcctgccatgctgccagaatggcggctggcgtctcggcgacgatgcgtttctgtgtatgtacttcaagcccaagcgtattgtcggcttttaaggagggatgctggctggacatttgacggcctttactgagttatctggccgtagtttaccgtatcagagaggggttctcaggctgttttcgggggttatgatgaggtttttcacgatctgcagacgtaaaaaagccccgcactttcgtgcggggcttcttcacttatttaatgcctggcagttccctactctcgcatggggagaccccacactaccatcggcgctacggcgtttcacttctgagttcggcatggggtcaggtgggaccaccgcgctaaagccgccaggcaaattctgtctccgcgccgcccgtaaggccgcgcagaatatccggtacaggctgaaaattctgtctctcaaaaacgcctctggcgttgtaaggttaagcctcacgggtcattagtaccggttagctcaacgcatcgctgcgcttacacacccggcctatcaacgtcgtagtcttcaacgtcccttcaggactctcaaggagtcagggagaactcatctcggggcaagtttcgtgcttagatgctttcagcacttatcttttccgcacttagctaccgggcaatgccattggcatgacaacccgaacaccagtggtgcgttcactccggtcctctcgtactaggagcaacccccctcaattctccagcgcccacggcagatagggaccgaaactgtctcacgacgttctaaacccagctcgcgtaccactttaaacggcgaacagccgtacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgagccgtcactctcgcagtcaagccagcttatgccattgcactaacctcacgatgtccgaccgtgattagctgaccttcgtgctcctccgttactctttaggaggagaccgccccagtcaaactacccaccagacactgtccgcagcccggattacgggcctacgttagaacatcaaacattaaagggtggtatttcaaggttggctccacgcagactggcgtccgcgcttcaaagcctcccacctatcctacacatcaaggctcaatgttcagtgtcaagctgtagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttctccttgcggataaccccatcaattaaccttccggcaccgggcaggcgtcacaccgtatacgtccactttcgtgtttgcacagtgctgtgtttttaataaacagttgcagccagctggtatcttcgactggcttcggctcggggagtaaatccctccacctacgcgccagcgtgccttctcccgaagttacggcaccattttgcctagttccttcacccgagttctctcaagcgccttggtattctctacctgaccacctgtgtcggtttggggtacgattctgtgttacctgatgcttagaggcttttcctggaagctgggcatttatcacttcagcaccgtagtgcctcgtcgtcacgcctcagcgttaacaagcgtccggatttacctggacactccgcctacacgcttaaaccgggacaaccgtcgcccggctgatatagccttctccgtccccccttcgcagtaacaccgagtacaggaatattaacctgtttcccatcgactacgcctttcggcctcgccttaggggtcgactcaccctgctccgattaacgttgaacaggaacccttggtcttccggcgagcgggcttttcacccgctttatcgttacttatgtcagcattcgcacttctgatacctccagcatgcctcacagcacaccttcgacggcttacagaacgctcccctacccaacaacacatagtgtcgctgccgcagcttcggtgcatggtttagccccgttacatcttccgcgcaggccgactcgaccagtgagctattacgctttctttaaatgatggctgcttctaagccaacatcctggctgtctgtgccttcccacatcgtttcccacttaaccatgactttgggaccttagctggcggtctgggttgtttccctcttcacgacggacgttagcacccgccgtgtgtctcccgtgataacattcttcggtattcgcagtttgcatcgggttggtaagccgggatggccccctagccgaaacagtgctctacccccgaagatgagttcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccagttaagactcggtttccctgcggctcccctatacggttaaccttgctacagaatataagtcgctgacccattatacaaaaggtacgcagtcacccccataaagaaggctcccactgcttgtacgtacacggtttcaggttctgtttcactcccctcgccggggttcttttcgcctttccctcacggtactggttcactatcggtcagtcaggagtatttagccttggaggatggtccccccatattcagacaggataccacgtgtcccgccttactcatcgagctcacagcatgtgtgtttttgtgtacgggagtatcaccctgtaccctgcgactttccagacgcttccactaacacacaagctgattcaggctctgggctgctccccgttcgctcgccgctactgggggaatctcggttgatttcttttcctcggggtacttagatgtttcagttcccccggttcgccttgcagcactatgtattcatgctgcaatgatgcacagagtgcaccgggtttccccattcggacatcgacggctgtagcggttcatatcaccttaccgtcgctttacgcagattagcacgtccttcatcgcctctgactgcctgggcatccaccgtgtacgcttagtcgcttaacctcacaacccacaggcgtttttcaacgctgcgtgttgcaagcatttgagagactcgaacgcatcgccaaatcattccttattacggaggaatgacgcgctgcgtcgtttcaattttcagcttgttccggattgttaaagagcaaatatctcaaacgcggcccggctgcttacgcaaccaaatcggttttgagatactgtatggagacacctttcacctgtcaccaagcaggtggcgtcccctaggggattcgaacccctgttgccgccgtgaaagggcggagtcctaaccgctagacgaaggggacacaaaagtgtcacgacttcgcagccgtcctgctcattactttttatcagacaatctgtgtggacactgcgcgggaaggtatcttcaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcacggagtcgagttgcagactccgatccggactacgacgcactttgtgaggtccgcttgctctcgcgaggtcgcttctctttgtatgcgccattgtagcacgtgtgtagccctactcgtaagggccatgatgacttgacgtcatccccaccttcctccggtttatcaccggcagtctcctttgagttcccgaccgaatcgctggcaacaaaggataagggttgcgctcgttgcgggacttaacccaacatttcacaacacgagctgacgacagccatgcagcacctgtctcagcgttcccgaaggcaccaaagcatctctgctaagttcgctggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccactcctcaagggaacaacctccaagtcgacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactcaagcctgccagtttcaaatgcagttcccaggttaagcccggggatttcacatctgacttaacagaccgcctgcgtgcgctttacgcccagtaattccgattaacgcttgcaccctccgtattaccgcggctgctggcacggagttagccggtgcttcttctgcgggtaacgtcaatcgacagggttattaaccccgtcgccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggtgggccattaccccgcctactagctaatcccatctgggttcatccgatagtgagaggcccgaaggtccccctctttggtcttgcgacgttatgcggtattagccaccgtttccagtggttatccccctctatcgggcagatccccagacattactcacccgtccgccactcgtcacccaagagcaagctctctgtgctaccgtccgacttgcatgtgttaggcctgccgccagcgttcaatctgagccatgatcaaactcttcaatttaagtttgatttgcttaaacaagttaagcggtgctcatctgtaaaacgtcataatgaatttcattatgtgttcactcgtgaggcttgatatttttttacgtccggagacgctgatatcaatcctgcgagtgcccacacagattgtctgataaattgttaaagagcagtgcgaacagtgcgttagcgtcctgtcgcgaggtggcgtatattacgctttcctcctgcagagtcaacctctttctcagaagtttttctccggcggcgcagtctcctgtgcctctcaacccgcttcccgttgccggtgttccgtgtcgatggaggcgcattatagggagtttccgcgggctgacaagcgtttctttgaattaatttgctgagcgcatcttttttaaacgaacggcttaaaaagagacgtttcatgacggaataacgcacaaagatcgccattaaacgttgtaaagagacctgccgttgcttaatgcgggtgctattattttgcttcttctcgcaggataaccccaggaaggatactcaatgataaaatccgcgcgcagcatggctggtttgccatggatagctgccatggcctttttcatgcagtcactcgacgccaccatactgaatactgccctgcccgctatcgccaccagcctcgaccgtttctcctctggccatgcaatccgccgtcatcagttacaccctgactgtcgctatgttgattccggtcagcggctggctcgccgatcgctacggcacgcgcaaggtatttatcgttgccgtttcgctgttcaccctgggctcgctggcttgtgcactttctcccacactccaggtactggtcatctcgcgcatcatacagggcgtcggtggcgcaatgatgatgccggtcgcgcgactggcgctgttacgcgcctatccgcgcagtgagctgttgccggtgctcaactttgtcaccatgccgggattagttggcccgatactggggccaatgctgggcggcgtgctggtgacctacgcgacctggcactggattttcctgattaatatcccgattggcattctcggcattatctacgcacgcaaatatatgccggacttcaccacgccgaagcgccgcttcgactttttcggcttcttattgttcggggctggactggtgatgatctcgattgggattgagctgtttggcgagcggattgtttccgcctggctggcgggcgggatattactcagcgggattgtgcttttgcttctttatatagtgcatgcccgaaatcacccttcgccactgatcaatctgccgatgtttaaaacccggacgttctcagtgggcatcggtggcaacatcgcgtcacgtcttggcaccggttgtgtgccctttttgatgccgctcatgttgcaggtcggctttggctattcagcgattatcgcgggctgcatgatggcacctatcgccattggttcaatactggcgaagtcgacggtgacgcaactgctgcgctggctgggttaccgccgcctgctggttggcattaccgccattattggcattctgatcgccagcttctctctgcagtcgcccgctgaaagcatcatcgtgctattacttccgctgtttattctcggcatggccatgtctacgcagtttaccgccatgaatactatcaccctggccgatctgaatgatgataacgccagcggtggtaacagcgtgctggccgtgactcagcagctagcgatcagttttggtgtggccgtcagcgccgcggtgctgcgcttctaccaggagtttgaaaccagcaccatttcacagttccacgccacgtttatgaccatgggcgtggtaacagtactgtcggcgctgacctttatgctgctgaaaaacggcgatggccgtaatctgatcagtaatcgcgacaaaaagaaaaagcgctaaaccgatccacgcaccaccagttccggcgtcagcaccagcgtttgctgactggcgtcgggattgctgagacgatggagcagggtgtctatcgccagttcacccagcgcatctttcggttgatgaatggtactcagtggcggagtgagatagcgcgccagttcgatatcgtcatatcccattaccgccatctgctgcggaacctgcatgccggcctgatagagtgcgtgataaacgcccaccgccatggcatcgttgctggtgaaaaccgcttccggcggcgtttccagcgccagcagttcgaccatcccgttgtagcctccctggaattcaaagtcaccattcaccacatagccgggcagaatcgtcaggccactctttgtcatggcgttgcgataaccttccaggcgcatacgagccggggttttatcctgtggaccggcgatacaggcgatgcgggtataaccactgtcgataagatgctgagtcgccagctccccgcccagcagcgcgttatcctgaataatgtcaccacggccttcaaacggcgcccagtccatcatgacggcaggtatagagggataacggttcagaatgtcggccgagggcaggtgactttccgtacacataatcaataaaccgtcgacgcgcttctgcatcagcgtttccaggctgcggttcatccgctcttcatcacctgccgtgttacagagaatcaggctgtagccacgctgatagcagctctcctccacaccccgcaccacttcggcataaaatgggttactactggtggtcagaagcataccgatcgtgtgcgtctgattgattttcagactgcgcgccagcgcagagggggcgtaattcagatggcggatggcctgctcaactttttcgcgcacgccttcactaacaaagcgattgttattgataacgtgcgagacagtggaggtagagacgcccgccaggcgagcgacatctttcatggtgctcaaatgcttagccctgctgctgcaaaaattcatcgatctccgcgcgccacggcacggagggctgcgcacccgagcgggtaacggcgatagcagcggcggcatgggcaaaccgcaccgcgtcatacatcgttttctgctccagtcgcgcggtgataaaggcgccattaaaggtgtcgcccgccgcgatggtgtcgatagctttaacactgaagccagcaatacgctgaccttctccctgctcgctcagccagacaccgcggcgacccagagtaatcagaaccgtgccgatacctttcgcatgcagtactgccgcagcgcgggcggcatcttcatcgttgctgaccgcaatgccggtcagactctcggcttcggtttcattcggggtaataatgtcgatcaacgccagcagttcatctgagagctgggtggcgggtgcaggattgagaataacctgcgtctgatgctgtcgggcaagcgtcgcggcggccagcacactttccagcggtgattccagctgcattaatagtgcatcggcgtcggcgataacctgctgatggcgcgtcacgcaggcgggtgttaacgccgcgtttgcaccggagtagatgccgatgttgttctcaccgtcaccattgacgaaaatcatcgccacgccggttgactcaccctcgaccacttcgaccggcgtagtatcaatattgtcctgggccagttgctgacgaacacgttcaccaatgtcgtcagcgcccacacaggcgataaatgcgatatcggcaccagcacgaccggcggcgacagcctgattcgcacccttaccgccaaacgcaatctgataattctgcccgatcaccgtttcaccgggacgaggaaagtgcgccagattaaggatgtggtcagcgttaatgctgccaagaacggccagttttgcgtttttgctcattaggggagtccggaataagtgcgccaccaggagggtggcgcagtgccctgcttttctttgagttattgagtgaccagcttcaggtcgaccgggttgatcgccttcactttttcacccttcagcactttatcagcggtatctacgccgatcatgccaattttgtctggcatctgtgccacagtcgcggacagtttgccaccttctaccgctttaacgccatcagcagtaccgtcaaaaccaacgacgatcacaccagttttaccggcggtctgcagcgcacgcagtgcacccagcgccatttcgtcgttctgagcgaatacggcctgaacgtccgggtgtgcctgaagcaggttctgcatgacgttcagacctttggtacggtcaaaatcggctggctggctggcgaggatctggaatttatgcgcatcagcggcctgtttgaagccttcgccacgctcacgggcggcagaagtcccggcaatgccctgcagttcgataattttggcgttttcgccgacttttttggcgatgaagtcgccggccattttaccgccgaaacggttatcggaggcgacgtggctgacaacggtgccctgtgccgcaacgcgatccagcgtgataaccgggatgttcgcctggttagccatcttcaccgcattgcccacagcatcagagtcggttgggttgatcagcagcaatttggtgccgcgaaaccgtcagatcctgcacgttagccagctctttcgccgggttgttctgtgaatccagcaccaccaggttgtagcccagcttgtccgcttctttctgcgcgccctctttcagcgaaacaaagaacgggttattcagggttgaaaccaccagcgcgatagtatctttagccatagcgctggtactgagcgttgcgccaaggatcacggccagtgcggttaactttttcatcatgtcatcctgtgtaaggtcagagttatttactgcttttattatctaccagcaccgccagcaggattactaccgccttaacgatcatctggtagtacgaagagacgcccatcaggttcaggccgttgttcaggaagccgaggatcagcgcgccaatcagggtgccgaaaatacggcccttaccgcctgccaggctggttccgcccagcacgaccgcagcaatcgcatccagctcatagccggtacccgctgtcggctgtgccgaagaaaggcgcgccacttcaatggtgcctgccagcgctgccagcatgccactcagtgaatagacgatgattttgacgcgattcacattgatgccggagagacgcgttgccgcttcattaccgccaagcgcatagatatagcgacccagacgggtgtgctgcagcatgtaccaggcagcaataaagaccagcgccatcagccagaccggcgctgggatacccagcggacgaccaataccaaaccagcccagcagatcggcattggcattaaaacccgtgtttaccggactgccatcggtgtagaccatggtgacaccacgcagcagcagcatcatgaccagcgtggcgataaacgcctgcactttgccgcgcgccacaatggtgccggtcagggcaccgattgccgctcccagcgccagcgacgccgccaccgcgaccagggcattgacctccatacccaccagcgacgcacccaccgcgccagtcagggccagcagcgatcccacagagaggtcgataccagaagtcaggatcaccagcgtcatcccgaccgccataatggcgttaaccgaggtctgctgcagaatgttgaacaggttcgccacggtaaagaagttcgggctctggctggccaccacggcgatcagcaccatcagcgcaatcagcgacttctgttccagtagccagcttttgctaaaccagcgacggctggcaggtaaagtttgggtcgtcataccactaaatcctcgctgtgttgcttgcctacggcggctgccatcaggctctcctgagtggcttcttctcgggtaaattcgccgctgatacggccttcatgcatcaccagaatccgatcgctcatgcccagcacttccggcatttccgaggagaccagaatgatgctcagcccttcggctttaaactggttaatcagttgatagatctctttcttcgcgccgacatccacaccgcgtgtcggttcatccagaatcagtacgttaggccgggtcatcagcccgcgggcaatcgccactttctgctggttgccgcccgaaagcagaccaatgggctgctccattgaaggcgttttaacgttaaacagccggataaagtcgcccacggccagctgctctgccgcatgtttcagcgtgccgctgccgtgactgaaatagcctaacgctgtcagcgacatgttctcttttactgacatgcccagcaccaggccatcgcgcttacgatcttcggagatatagacgatgccgttagccagcccatcctgcggtgagcgcgtcaccacttcccgaccattgagccacagtgtgccttcgcgacgcggcagggcgccgtaaagcaccttcatcagttcggtacggcccgcgcccattaagccggaaaccccaaggatttcacctttgcgcaggctgaaactgacgttatccacgcccggtccgctgacgttctccactttcagccgcacgtcgcctggcgcctgatcaatatggggatattgatcttccagcttacggccgaccatcatttcgatcaggctctcttcggtcagttcgctgaccgggcgttcagcaataaactgaccgtcgcggaacaccgtgacgtcatcgcagatctcaaagatctctttcatgcgatgcgagatatagacgatgccgcagccctgcgctttcagttcgttgatcacccggaacagcgacagcgtttcggtatcggtcagcgcatcggtcggctcatccatgatgatcacctgcgactcaaagctcaggactttggcgatttcgaccatctgctgatcgccaatcgacaaatcccccaccagcttgtggctgttgaagcgcagattaagccgtttaagcagcgcatcggcttcggcatacatgcgcggccactggatacggccaaaacggctgacatattcgcggccgagaaaaatattctccgccacggttaattgagggatcaggttcagttcctgatgaatgatgccaatacccgcttcctgagacgctttcggcccgctgaaacgggtctctttgcccagccagcgcagcgtaccggcatcatattgatagatgccggtcagcactttcatcatggtggacttgcctgcgccgttctcgcccaccagcgccatcacgcgtcctgcccggacattcagcgacgcccccttgagggctttcacacccggaaaagatttttcaatgccgtcgagttgcagtaaaggttgcatagcggcctcagaaggtcacaccggcgctgaggatgacattcgcaaacggagagcactctccgctgcgaatgaccgcctgactacgctgcgtttgttgtttgaattgttcatgactgatgtagctgatggtgatgatattcccctggtgctgttgcaaggcttcgagcacggcgacaagcgcgctatgaagtggcggattatgctgcttaatctcttccgcgatcagggcgctctctacctgcatctccagtgcgacagcattaaccacctgcataaaatcgggcgtacccggcgtgagcgctaaatcgatgcgctgcggtccggccggaatcggcaagcctgcatcagcaatcgtcagcgtatccgtgtgtcccaggcgggcaatcacatgagagagttcagcgtttaacaagcgaccttttttcatcttttcactccacagcgaaacgtttcgctgtcaggagtgtatgaaaagccgccatcaactcaaccggcaaagaagaaatctgtgatcgctatcgaaacgtttcgctcacgcggggagaaatttgtattaagtcggggatcgggcagaaacaagggccgcgaaacgcggccccggaggagaggattaaggcagtttcttaacctgcttaacgtccatctcaatgctgttgaaatctttatccagttcacccgtcagctcgacgttgtctttaggtgagatagtctggccgttccagtgcttgtggtcgatttcgactttcatggtgccggtctggtcgcggaacagataatcttcgttgcctatctgtttctccagcttaccgcgcacggtgacccagctgtcatctttcatctcttcagcctgctttacggtcaccacactggtgtgatcggcactgaaaccaccctgaccggctgctgcctgcgtctgtgcggctggcgcactaggatcaacaaatccaccctgctgtgcagcgaaaaccggggcggaagccagcattacgacggccagaattgcagcgtgctttttcattttgtcacctcttttccatgatgtggttcgtcttgttgagcttagttgaccataaagttcttaacagcttcttaagaggcaaaaataagctattttcgccgaaatcagctgtacaagcaggaagttgcttcgtataaagcgctatcggaacagggagacgtgatgcgtattttactgattgaagatgaccgtttaattggcgacggtatcaaggcggggctgagtaaactgggcttcagcgttgactggtttacctctggtgaggcgggctttaacgcgctggaggccgcgccctgggatgcggtgatcctggatctctcactgcccgagcgggatgggctcgatattctgcggcagtggcgacagcagggcaaagatgtaccggtactgatactgaccgcacgcgatgcgctcgatcagcgggtcgaaggcctgcaaatgggagccgacgactatctgtgtaaaccctttgccttaactgaagtggctgctcgcttacaggcgctgatccgccgccgtcatggccagctgcagcccgaactccggcacggtaatgtggtgctgatccccggcagccatagtgtgatgcgcgaaggtgaggcgattgcgctgaaaagccgtgaactggcgctgctggaactgtttatgcgaaacccgggccgggtgctgacacgcagccagctggaagagaagctctacaactgggacgccgatgtctccagcaatgcggtagaggttcacattcatcatctgcgtaaaaaactgggcagccagtttatccgcacgctgcacggcgtcggttataccctgggagcggctgaatgcgatcaatgagcctgtttctgcggctgggtatcggttttgtgctgctgctcgggatctgctgggccagcgccagcctgagtgcctggcatcagacacgtgaaacccttgatgagctcttcgatacccagcagatgctgctggcaaagcgtctgctgacgctggatttctcctcgctggacaacgccactctgcctaaaaccaaagagatactgcgccaccatcgcggcgatcaggatgacgacgccctggcctttgccgtcttcacgcgtgacggccggcaggtgatgaatgatggtgacaatggccgctacctgccgtttgaggcggagtatcagggatttcatgagggccagctcaccaatgatgacgatcgctggcggtttgtctggctgactacgcccgaccagcagtttccgggtggtggtgggtcaggagtccgaataccgtgacgacatgacgcgggatctgatgaaagccagcatgctgccctggctgatcgcgctgccctttatgttgctgctgctgatcggtctggtctggtctgaactgcgccccctgaagacgctggcacagcagctggcgcagcgcgcacccgatgatgatacgccgctgcaggcagaccgcgtgccgaaagaggtgcaaccgctgatggtcgcgctcaatggtctgttcagccgcatcagcgcaatgatgcagcgtgaacggcgctttacctctgatgccgcacatgagctgcgcagtccgctggcggcgctgcaggtgcaaagcgaggtgatccagctgactgcggatgatgaagtgatgcgaagccatgcgctacagcaactggatgccggcattatccgcgcaacccggctggtggatcagctgctgacgctctcacgggttgaagctgatgatgcacgcagcgccttcgaaacggtggcgctgaaacgcacggtccaggagacgctggctgcacagctgccgctggcggataaaacgggtgtcacgctgcggctgcatgctgacgccgatccgcagattcaggggcatccgctgttactgtcactgctggtgcgtaatctgctggataatgccattcgctatacgccagcgggcagcgaagttgatgtgcggcttcaggcgaatagcctgtcggtagaggataacggcgaaggtctgagtgcagccgatctgcaacggcttggtgaacgtttctggcgaccgccaggtcaggagaaaagcggaagcgggctgggattatcgatagtccgcaatatcgcccagttgcacgggatgcaggtcagcttcagccagcgctcgggcggcggattatgcgttatgctgcgctggtcagcgcccgccctgtaaggcgggcactgcagattaaatctcgacctgggtgcccagctcaatcacccggtttggcgggatctcaaactggtctggcgcacggagcgcattgcgctgcagcgccaggaagagtttgccacgcaggcgcagataccacggccgtttgccgataatcagcgactcatgcgacatgaagaacgatgtctccatcatgcggcagttgagcccttccagcccgcagcggtggaaaatctcctcgacgtttggcgtttcgcgccagccgtagctggccaccacccgccagaaggtgggcgacagctgctcaatcgtcacgcgacgcacgttatgcacgtaaggcgcatcttccgtccgcaacgtcagcagcaccacccgctcatgcaacactttgttgtgtttgaggttatgcagcatggcaaacggaatcacattcagcgcacgcgacatatagaccgccgtacccggcacgcgaaccggcggcgatttctccagtgacgcgatcatcgcctccagggagttgccatgctcgtgcatgcggcgcagcaggcggaaacgttcgcttttccacgtcgtcataatgataaacatcaccaggccgagacagagcggcagccagccaccggagaagattttcaccaggttggcggtaaacagcggcacatcgatacagagcatcagtaccaggatgacggcaaccgccagcttattccagtgccagtttttaaccgccacggtacaggagagcatcgcggtcagcaccatggtgccggtgacggcgataccgtaggccgcagccagattacttgaatgctcaaagctgataatcacaatcagcacggcgaagtagagtacccagttaatcaccggaatatagatctggcccgattcgcgctcagaggtgtggatgatacgcatccccggcagatagcccagtcgcaccgcctggcgcgtcagcgagaagacgccggagatcaccgcctgtgaggcaatcaccgtggccagcgtcgccagaatcagcatcgggatcagcgcccagtccggcgccagcaggaagaagggatttttaatcgctttgggatcgctgagtaacagcgcgccctgaccaaagtagttcaggaccagcgacggcagcaccaccgagaaccaggccagtcggatcggcactttaccgaagtgacccatatcggcatacagcgcttcaaccccggtaatcgccagtaccacagcgccaagcgcgaagaatgagacagatttatagtgcaggaagaactcgaccgcgtaggcaggattcagcgcatgcagcacttccgggtttttcatgatgccgctgacccccaggatcgccagcaccaggaaccacaccagcatcaccggcgcgaagagtttgcccaccatgccggtgccatgtttctgaatcgcaaacagcagcgtcagcaccgcaatcgacatcggcacaataaagggatccagcgacggcgcggcaatctccagaccttcaatggctgacatcaccgaaatggccggcgtgatcaccacttccccatagaagaagctgccgccaatcaggcccatgatcaccagcactgccgtggcgcgtgcacccgtatggcggcccgccagcgacatcagtgtcagaataccgccttcaccggcattgtcggcgcgcatcacataactgatgtacttcagtgataccaccagcaccagcagccagaaaatcagcgacaaaaagccaaacaccgcttcccgctcaacgccgaagccgaactgtccggagagacattcacgcaaggtatacagcggactggtgccgatatccccgtaaacaacaccaatagcggccagcgttaatccgcgaagtgactgcttattatccgagctcatagagttatcttttgttggagtctaagaggcgcaacaacccctcgctcaggccatcaaaaagcgcacagtatgcacggtttgccgaaaattcctatacccgcttcgcctgtctgccagggtaatagggtggtttcaggcattaaagcgttaatcagcgccgctttcaaagcaggcaaaccttatgaaacaaaaaagctgacagctatcaacgctttcacgcatgatgatctatagagtaaggcgcttgctgaagcgcggcggcccgacgatcgtaaggacattgaagtgattatggctcaaccccatcttttggcagaaagaatttctcgccttagcaatgcgttagaaaaaggattgtatgagcgacatcatgccatccgcctttgcctgctggcagcgctgagcggtgaaagcgtgttcctgctgggaccgcccggcatcgccaagagcctgattgcccgccgcctgaaatatgcctttcagcacgcccgcgcctttgaatatctgatgacccgtttctccacaccggaagaggtgtttggcccgctatctattcaggcactgaaggatgaagggcgctatcagcgcctcactaaaggttatctgcccgacgcggagattgtttttctggatgagatctggaaagccggcccggcgattctgaataccctgctgaccgctatcaacgaaacgccgcttccgcaatggcgacagcgaagaggccattccgatgcgtctgctggtcaccgcctctaatgaaatgccggaagcggacagcggccttgaagcgctctatgaccggatgctgatccgcctgtggctggataatgtgcatgagaagcagaactttcgcagcatgctgacccatcagcaggatgagcacaccaatccggtcgcggaatccctgcgcattagtgatgaggagtatgcgcagtggcagctcggcatcagtcaggtcagcctcccggatgcggtgttcgagctgatttatcagctgcgccagcaactggaaagccagcccgccgcgccctatatttccgatcgtcgctggaaaaaagccattcatctgctgcaggccagcgccttttacagtggccgcagcgccattgcgccgatagacctgatcctgctgaaagattgcctctggcacgacgtcgcgtccatgcagctgctggagcgcgaaatcgatcagctgatgacacagcacgcctggcagcagcagccgatgctgctgaaactgcatcagataaaagcgcgtcgcatggctctgcaacagcaacagagcatcgcacaggcgatcaccctggaaaaacacagtgggatgttcagtcgcaaaccccattacgatctgccggaaagcttcactgatgagcaactgacgctgatgctgcaaaagccgctgatgctgcatgacatgcaggtgacacatctggttatcgcgcgtgatgcactgaatcagtggctgcagaaagggggcgaggttcgcggcaagctcaatggaattggctttgcgcagagtctggatttacaggtggatgcgcagcactgcctggctatccgtgatgtcagcctgcaatcgtcgcgtctgacactgcctggcgtcagcaatagcgagccgctgcccggtgagatcaccgaagcgctggatgcactggagagtgaactgcggtcgcagcgtcatctgttcagccagcatcagcgctgcctgtttatcagtgatgactggctggcgcgcgttgaaaccagcctgcaggatgtggcggaacagttgaaacaggcgcgtaaatgatcccactggagacgctcagcacactgctctccgtgggtgaaaccgaactgattgaagagctgattattgccctgctggcgtctccacagctggcgctgttttttgaaaagtttcccgggctgaaaaaagcactgttacgcgatgtgccacgctggcgagcggagatcaacgctgagctcaaagccacgccggttccggccacgctggccgaagagtttcagctgttccagcgggtacaactcctcagcgatcgtgaattcagccaccagctgaatgccacgcttcaggcgcttgaaagcctgccttccccttttctggatgaagccaaccggctgctgcagcacaccgatatcagccatctcagcagcgcgcagcaccagctttttctacagcgctggcggctgagcctgaccttacagaccctgacgctgaatcagacgttgctggaacagcagcgcgaacgcctgctggcggaaactgcagcagcgtatggcgctgagcggtcagctggcaccgattcttggcgacgatgacgaagccgccgctggccggctgtgggacatgagcaaagcgtcactgcagcctggcgactatcaactgatgctgcaatatggcgactttctggcgcagcagccggagctgctgaaactggcccagcagctgggtcgcagccgcgaggcaaaatcggtgccgtcgcaggatgcccctatggaggccttgcaccatatggtgcaggaacctgcggccgtgccggaggaggtcagcggcattcaccagagcgatgacgtgctgcgtctgctgccgccggagttagctgcgctgagtatcagtgaactggagctggagttttaccggcggctggtagagaaacggctgctgacctacaagctgcagggcgatgcctggcatgaaaaggtcacgatgcgtccggccagccaccagcagcatgaagagcagccacgcgggcctttcatcgtctgcgtcgatacctcgggttcgatgggtggcttcaatgagcgctgcgccaaagcgttttgtctggcgctgctgaaagtcgcgctggccgatcgccgtcgctgctacatcatgctgtttgcgcatgaggtgatcggctatgaactgaccggtgatgacgggctggaacaggcgattcgctttctcagtcagcgctttcgcggcggcaccgatctggcagcctgcctctcttccgttgtgacccgaatggaaggcgtcctgtggcaggaagccgatgcggtgatcgtctccgattttattgcccagcgtctgccggaagaggtgatcgggactattaaaacgcgtcagcgaaataatcagcaacgttttcacgccgtggctatgtcggcccacgggaaaccaggcattctgcgcatcttcgaccatatctggcgtttcgataccggcatgaaaagccgtctgctgcgtcactggcggcgttaagtcatcgggcagaaatgcatatttgctatagtaaattaccgtttcacttactcagcaatctggagcttcctgtgacgcttgctcaacctcatcgcgatctgcctgcgccgacgcgaacgctactgctctccggccataacattgaacaaaaacgtgccgaattgctggcctatttccaccagacctgggaacagtatgaaagtctgtttacctgtctggccgattcccaggcctggtttaccaaagccattccgctgcgccatcctttaatcttctattttggccacaccgctaccttctacattaataagctgatggccggacgccttatcgacgcgcgtctggacgatcgtatcgaagcgatgatggcgattggtgtggatgagatgagctgggacgatctcaacgacagccactatgactggcccactgtcgaagaagtccgcgaataccgcgggcgcgttaaagcgctggtcagcgatctgatccagaccctgccgctgactctgccgatcacctgggagagtccggcctgggtgatcctgatgggcattgagcatgagcgtattcatctggaaacgtccagcgtactgatacgccagttaccggtcgggtgggtgaaaccccagcccgcgtggccggtctgcccgatggcgcgccatcagcgcgaggctgttccggccaataccctgctgccgatgcccggcggcaccgtcacgctgggtaaaaccgacgatacctatggctgggatgtcgaatatggccgccagcagatcgcgctgcagccgttcagggcgagcaaaatgctggtcagcaacgcggaattcctggcgtttcgttgaggcggggggttatcaggacgctcgctggtgggatgacgaaggctggggctggtgtcagtttgctaaagcggagatgcccaccttctgggtcggcacgcctgcgatgcccgatcagcttaaactgcgtctgatgtgtgaagaagtcgcgatgccgtgggactggccagccgaggttaaccagctggaagcggcggccttctgccgctggaaagcggatcagacgggaatgagtgttcagctcccctgtgaagcggagtgggctcagctgcgcgaacaggtcgcgggcgatcagccggattgggatcgggcaccgggtaacattaacctggcgtactgggcttcctcttcaccggtcgatctcttcgcccagggcgacttcttcgatatcgtcggtaacgtctggcagtggacgaccacgccgaccaacggctttgaaggttttaaagtccacccgctttacgatgatttctctaccccgacctttgatggtaaacattcgctgatcaaaggcggtagctggatatctaccggcaacgaagcgctgaaatcggcacgctatgcgttccgccgccacttcttccagcatgccggtttccgctacgtggtttccagccatcaggaaaccatggcgctgaacccgtatgaatctgacgccatggtgtcgcaatacctcgacttccagtatggcccgcgctatttcggggtggataactatgccgaaagcctggtaaacctggcgctgaactacaccacagcacgcggcgaggcactggatatcggctgtgccaccggacgcgccagttttgaactggcccgccactttgaacgagtcaccggtatggactactcggcgcgcttcatcgatgtggcgcttcagctggccagcggcgaagacttccgttatctcctgccacaggaaggcgatctggtggagtatcgccaggttttcgcctgaaagatttcgcgctggagagcgaactggcgcagcggattcagtttgttcagggcgacgcctgtaaccttaagccgcaacccgcccgttacgatctggtacttgcatccaacctgatcgatcgcctgcgtcagcccgctcgcttcctgcgggatgtcacgccgatgctgcgtcagggcggcattctggtgctctcatcgccctatacctggctggaggatttcacgccgaaggagaactggctgggcggcgtgcgtgaaaacggtgaggcactgacgacgctgcaggcactgcaacgtctgctggcggccgacttcgacctggtcgatgaaccgcaggataaaccgtttgtgatccgcgaaacggcccgcaagttccagcatacgctggcgcaggtcaccgtctggcgcaaacgctaagtgaaccggcagcgacgcccgtcgctgccgggagttgcctgaaccactattttgctgcacattcatccttgtttacttaagcagaccaataacgaggatggccatggccgaacatctgcagctcgataacctggatcgcggcattctgaatgccctgctcgacaatgcgcgcactgcttacgccgagctggcaaaacagtttaacgtcagccccggcaccattcatgtccgcgtggagaagatgaagcaggcgggcattatcctgggcacccgggttgatatcgatccgcgccagctggggtttgatgtctgctgttttatcggcatcatccttaagagcgcgcgtgactatccggcggcgctgagcaaactggatgcgctggatgaagtggttgaagcctggtacaccaccggccactacagcatctttattaaggtgatgtgccggtccattgatgccctgcaacaggtgctgatcaacaagatccagaccatagatgaaattcagtcgacggaaacgctgatctcgctgcaaaacccgatcatgcgcactatcaagccctgatccttctccgccttgtgcataatcttatccctgacgaatgtggcggctggcaacggctgcgttcgcttctcttaatctattaaccctgttgtccacaggtggatcaccgcttgatcacagcgtacaatgctcgccttaatgtccgggagagcaagatggccgatattaccttaatcagtggcagtactctgggtagcgcagagtatgtggctgaacatctggaagaaaaattacaggaagcgggcttctcaacgcagatgctgcatggcccggagctggatgaagtgccacatgagggtatctggctggtggtctgttcaactcacggtgcaggcgatattcccgataacctgctgccgctgtttcgaagccatcacggaaagccagcccgatctctcgcaggtccggtttggtgccatcggactcggcaatcatgaatatgatctcttttgtggcgcgatccgccagattgaggccctgttaattgctcagggtgcccgccagatcggcgatcgtctggagattgatgtgctggagcatgagatccctgaagatcccgcggaagcctggctggaaagctggaaaaaggcgatctgaagggggctggggatcgcgaaatagtgacgatccccagtggaagatgctgattttatccttttccgctcgtttattttgtggataactaccctcttttactgcgtataaccggtagttatccaaagaacaaccgtagaatgaattttgagctgtggataacatgccattttgatcccagcttatacggatcaggatcaccgatcactaacaggtagtgatcctcttcatcctgttgtttctgctgtgcttctggcacatatccacagaaaagcgggatcctaataagagatctaacagaaagatcatatacagatctaagatcctttcttttaaaaccggacgatcccgcggctttcaccccagacggaatttgagtagaatccacgccccaggacgacgatcctgcaagtttcatcaaccgaggtaccacttcatgttttatcaggatccttttgacgtcatcgtaattggtggtggtcatgcgggcaccgaagccgcaatggcggcagcccgaatgggtcagcaaaccctgttactcacccataacattgatacgcttggacaaatgtcctgtaacccggcgattggtgggattggcaaaggacatttggtgaaggaagtggatgccctgggtggtctgatggccagtgcgattgaccaggcgggtattcagtttaggatactaaacgccagcaaaggtccggcagtgcgggcaacccgtgctcaggcggatcgcgtgctctatcgccaggcagtgcgtacggcactggagaaccagcccaatctgatgatcttccagcaggcggtcgacgatcttatcgtggaaaacgatcgtgtggtgggtgcagtcacccagatgggactgaagttccgcgcgaaaacagtcgtcctcaccgtcggcacgtttcttgacggcaaaattcatatcggtctggataattacagtggcggtcgcgcaggtgatcccccatccattccgctggcaaaacgactgcgtgcgctgccgctgcgggtagaccgcctcaagactggtacgccaccgcgtatcgatgcgcgcaccatcgatttttcagtgctcagcccgcagcacggcgataacccgatgccggtgttctcgtttatgggcaatgcgtctcagcatccgcagcaggtaccatgctggatcactcacaccaatgagaaaacccatgaggtgatccgcaataatctggatcgcagcccgatgtatgccgggatcatcgaggggatcggtccacgctactgcccgtctatcgaagacaaagtgatgcgctttgccgatcgtaactcgcatcagatcttcctggagccggaagggctgaccagcaatgagatctacccgaatggcatctcaaccagtctgccatttgatgtgcagattcagatcgttcgctccatgcagggcatggagaatgcgaagatcgtgcgtccgggctatgccatcgagtatgacttcttcgatccacgcgatctcaaactgacgctggagagcaaatttattcacggcctgttctttgccggccagatcaacggcacaaccggctacgaagaagccgctgcgcaggggatgctggcgggtctgaatgccgcccgtcagtctgcggacaaagagggctgggcaccacgtcgtgaccaggcttatctgggcgtactggttgatgacctctgcacgctcggtaccaaagagccgtaccggatgtttacctcccgtgctgaatatcgtctgatgctgcgcgaagacaatgccgatctgcgtctgaccgaaaccggtcgtgaactgggtctggtggatgatgcgcgctgggcgcgtttcaatcagaagctggaagcgattgaacaggagcgtcagcgcctgcgcgatatctgggtccatccgaagtcagagcacgtgacggaagtgaatacggtactcagtgcgccactgaccaaagaagcgagcggcgaagatctgctgcgccgtcctgagctgacctatctgaagctgatgacgctggatgcctttggtccggcactggctgatgagcaggccgctgagcaggttgagattcaggtcaaatatgaaggttatatcgcgcgtcagcaggaagagatcgatcgccagctgcgtaacgagaacacactgttaccggtggagctcgactatcgccaggtgaacggcctctcaaatgaggttatcgccaagctgaacgatcacaaaccgagttcgattggtcaggcgacgcgtatctccggtattacgccggcggccatctcaattctgcttatctatctgaaaaaacagggtctgctgcgtaaaagcgcctgatctgaaaacggggcgaggagactcgcccccgctgaatggacttatgctgtgatcaacacactcacgtcgctgctacaggcagccggtatttccctctccgatcaacaaaaacagcagctggttgcctatgtcggcctgctggataagtggaacaaagcctacaatctgacatcagtgcgcgatccgcagcagatgctggtacgccatatcctcgacagcatcgtggtggcgccgcatctgcaaggctcacgtttcattgatgtgggaaaccggaccaggactgcctggcattccgctggctatcgtgatgcctgatgcgcactttacgttgctcgacagcctgggcaagcgggtgcgtttcctgcgtcaggttcagcatgagttaggactcactaacattactccggtgcagagccgggttgaggcgttcccggctgagccgccctttgatggcgtgatcagtcgtgcatttgcctcgctgaccgacatggtgaactggtgtcatcatctgccgggaagagaagggcgctttttcgcgcttaaaggcgtgcgtccggacgatgaaattgcggagttaccggcaggctacgtctctgatgctgtgattaagttgcaggtaccacagctagaaggtgatcgccacctggtcattcttcgtcaccaataggctttcgactggcagagatttagcgtttatctgccagtgattttcgtcagttccgggctgaaaaaagtgcagatgatgcgctatcaataaaagattttgattaagccctggctgaccgaaggttaaaacgctaacggaaattatccgaaaagctctgttacatttaacgtttaattcacattcagttatcagaaatatcacttgtataggcgggtcgctgaataaaagtagtcacggcagaaaatatatcgcggtaataactttgcgtgcgtaatatcaattacacgattcttaagcacagttcgatgtcaatagcgtgttttctgtgaaaatagtcttgcagatgcatttttataatttcaatgctttgattttattgagttaatttgtaatacagattattcttaaatagcgcgaagataaaactcagtgtagtgaaagtgcttattatgtgatctaaagcacgctttaaaagcaagttgcaagggaattttcagtcagattagggtgaatctctgcagggtaatctttggaaaaatagccctccggaaagaaatttaaataattgttcaccttttcgctacttaccgattgaaatcgcaggtgcggcccgtataatttgcacggcttttgctgcttgactcaactgcgcaaaggcagtcttatacgacacgcgacatacccctaacggggcaggagagtatcagcgtcatgtcagtgtctctttacagtgtaaaatacgcccgaacggtgctgatgattcagctggtgacgatagtcatcatcggtgcactctttgctcttaaagatgtcatctggggtctctctgctcttgctggcggtgcggcagcctggctgccaaacgtattgtttttgtttttagcctggcgcctgcaggggcaaaccccagcttcggggcgagtcgcgtggagcttcgctttgggtgaaatagccaaagtgtttgcgaccatcattttgctcattgtggcgttgggtctattcagagcggttttctggccggtcggaataacctggttatcggtgctggtggtacaaatgctggcaccggcggtaattaacaacaaagggtaagaggcatcatggctgcaggagaaatctctactccgcaagagtacattggtcaccacctgactcatcttcagttggacctgcgtaccttcgagatagtgaatccgcacgacgctcccgcgacgttctgggtattaaatatcgattccatgtttttctctatggtgctgggaatcatcttcctggtgttgttccgtagcgtggcaaaatctgccaccagcggtgtgccagggaaaatgcaggcggctatcgaactggttgtcggtttcgtcgatagtaacgtgcgcgacatgtatcacggtaagagcaaacttatcgccccgctggctctgacaatctttgtctgggtcttcctgatgaacttcatggatctgctgccaatcgacttgctgccatatattggcgagcacgtattggggttaccggcgctgcgcgtcgtaccgtctgcagacgtgaacatcacgctatctatggcgttgggcgtatttattttgattctgttctacagcatcaaaatgaaaggcattggcggcttcactaaagagctgacgctgcagccttttaaccacccgatcttcatcccgatcaacctgattctggaaggtgtgagcctgctgtctaagcctgtatcactgggtttacgactgttcggtaacatgtatgcgggtgaactgatctttatccttattgccggtctgttgccgtggtggtcgcagtgggtgctgaatgtgccgtgggccattttccacatcctgatcatttcgctacaggctttcattttcatggtcctcacgattgtctatctgtcgatggcatctgaagaacattgatttttttctcaacactactttccctcttgatttcgggttgcagcgcacaccgctgaagcccggaagatgaagggagcatttaactgaaacaaactggagactgtcatggaaaacctgaatatggatctgctgtacatggctgccgctgtgatgatgggcctggcggcaatcggtgctgcgatcggtatcggcatcctcggaggaaaattcctggaaggcgctgctcgtcagcctgacctgattcctctgctgcgtacgcagttctttgttgtaatgggtctggtggatgcaatcccgatgatcgctgttggtctgggtctgtacgtgatgtttgctgtcgcctaaagccctgtgttcactcagcgcacaatgtgcaagggtgaacggattctgccgcttatcgttgataacggcagaaaagttaaatactcaatctagaggcattgtgctgtgaacattaatgcaacaatcctcggccaggctatcgcgttcatcctgtttgtcgcgttctgcatgaagtacgtatggccgccgctcatggctgctatcgaaaagcgccagaaagaaattgctgaaggccttgcttctgctgaacgtgcaaagaaagatttggatctcgcgcaggctaatgcgaccgaccagctgaaaaaagccaaagaagacgctcaggtcattatcgagcaagcgaacaagcgtcgcgcgcagattctggacgaagccaaaaccgaagctgaaaacgaacgtaatcgcatcgtgacacaagcgcaggctgaaattgacgctgaacgcaaacgtgcgcgtgaagaactgcgtaagcaggtcgcgttgctggctatggctggtgccgagaagatcatcgaacgctccgtggatgaagctgctaacagcgacatcgttgataaactggtcgctgaactgtaaggagggaggggctgatgtctgatctgattactgtagctcgcccctacgccaaagcagcttttgactttgctgttgagcatcaaagtattgaacgctggcaacagatgctggcgtttgccgcagaagtggctcgcaatgaacagatggctgatcttctctcaggtgcattagcacccgaagcgctggcagcgtcgtttaacgcagtctgtggtgatcaactggatgaacccgcgcagaaacctgattaaggtgatggcggaaaacggacgtttgacagcgcttccggctgtactggcccaatacatcgaactgcgtgacgctcatgaagctaccgctgaagttgatgttatctccgccagtacgctgagtgacgaccagctgaataaaatcagcgccgcgatggaaaaacgtctgtcacgcaaagttaagctgaattgcaaaattgataagtctgtgatggcaggcgtgatcatccgttcgggtgatctggttattgatggcagcgtacgcggccgtcttgaccgtctggctgacgtcttgcagtcttaaggggactggagcatatgcaactgaattccaccgaaatcagcgaactgatcaagcagcgcattgctcagttcaatgtcgtgagtgaagctcacaacgaaggtacgattgtttctgtaagtgacggtatcatccgcgtacacggcctggccgatgtcatgcagggtgagatgattgccctgccgggcaaccgttacgctatcgccctgaacctcgagcgtgactcggttggtgcagtggtgatgggcccttacgctgacctcgccgaaggcatgaaggttaagtgtactggccgtattcttgaagtaccggtaggccgtggcctgctgggccgcgtagtgaacaccctgggtgctcctatcgacggtaaaggcgcaatcgacaacgacggtttctcaccggttgaagtcattgcacctggcgttatcgaccgtcagtcagtcgaccagccggttcagaccggttataagtcggtcgatgcgatgattccaatcggccgtggccagcgtgagctgatcatcggtgaccgtcagaccggtaaaaccgcaatggcgatcgatgcgatcatcaaccagcgcgactcaggcatcaagtgtgtctacgttgcgattggtcagaaagcctcaaccatctctaacgtggttcgtaagctggaagagcatggcgcactgcagaacaccatcgttgttgtggcgtctgcttctgaatctgctgcactgcagtatctctctccgtacgcaggctgtgcgatgggcgaatacttccgtgaccgtggtgaagacgcgctgatcgtttacgatgacctttctaagcaggctgtcgcgtaccgtcagatttctctgctgctgcgccgtccaccaggtcgtgaagcattccctggcgacgtgttctatctccactcccgtctgctggaacgtgcatcacgcgtaagcgctgattatgtagagcgtttcaccaatggcgcagtgacaggtaaaaccggttcacttaccgcgctgccgatcatcgaaacccaggcgggcgacgtttctgcgttcgttccgaccaacgtaatctcgattactgatggtcagatcttcctggaatcgaacctgttcaactccggtattcgtccggccgttaacccaggtatttcggtatcccgcgtaggtggtgctgcacagaccaagatcatcaagaaactgtccggtggtatccgtaccgcgctggcacagtatcgtgaactggcggcattctcgcagttcgcctctgatctggatgatgcaacccgcaaacagctgagccacggtcagaaagtgaccgagctgctgaagcagaaacagtatgcgccgatgtctgtcgcacagcagggtctggttctgttcgctgcagagcgtggctatctgaacgacgttgaactggcaaaaattggcagcttcgaagctgcactgctggccttcgccgatcgcgaccacgctgagctgatggctgaaatcaaccagtcgggtaactttaataacgatatcgaagccaagctgaaaggcctggtcgagacgtttaaagcaacccagtcctggtaatgtctggcggcttgtctgaaaaggcaggccgcaaggctttgaggagaagctaatggccggcgcaaaagagatacgaagcaagattggaagcgtgaaaaacacgcagaagatcaccaaagcgatggaaatggtcgccgcctccaagatgcgtaaaacgcaggaacgcatggcggccagccgtccgtatgcagaaaccatgcgcaaagtgattggtcaccttgcgttgggtaatctggaatacaagcacccttacctggaagagcgcgacgtgaagcgcgtcggctacctggtcgtttcaactgaccgcgggctttgtggtggtttgaacattaacctgttcaaaaagttactggcggatatgaagtcctggtccgataaaggcgtgcagagcgatctgtcgattatcggttcaaaaggggcgtcattctttaatgctgtgggtggcaacattgtggcgcaagtcagtggcatgggcgataaacctaccctgtctgacctgattggcccggtaaaagtgatgttgcaggcttatgatgaaggccgcatcgacaagctgatgatcgtcaataacaaattcaataacaccatgtctcagactccgaccatcacccaactgctgccgttaccgccagcggaaggtgaagaagagatgaaggcgaagacctgggattacctgtatgaacccgatccgaaagcgctgctggataccctgctgcgtcgttatgtcgaatcgcaggtttatcagggtgtggtggaaaatctggccagtgagcaggccgcacgtatggtagcgatgaaagccgcaaccgataacggcggaaatctgatcaaagagctgcagttggtgtacaacaaagctcgtcaggccagcatcacccaggaacttaccgagattgtcggtggagcctccgcggtttaaccaggtttggaattaggtagaggattcaagatggcaactggaaagattgtccagattatcggcgccgttgttgacgtcgaattccctcaggacgcggtaccgcaagtgtacagcgccctcgaggttatgaatggtgatgcgcgtctggtgctggaagttcagcagcagctcggcggcggcgtagtacgtaccatcgcaatgggtacgtctgacggcctgaagcgtggtctgagcgtcaacgacctgcagaaaccgattcaggtacccgtcggtaaagcgaccctgggccgtatcatgaacgttctcggcgagccaatcgatatgaaaggcgagctgaaagaagaagatggcagcgcagtagagatcgcctctattcaccgcgcagccccttcttatgaagatcagtctaactcgcaggaactgctggaaaccggcatcaaggttatcgacctgatgtgtccgtttgctaaaggcggtaaagtcggtctgttcggtggtgcgggtgtaggtaaaaccgtcaacatgatggaactgatccgtaacatcgcggctgaacactcaggttactcagtgtttgccggtgtgggtgagcgtactcgtgagggtaacgacttctaccacgaaatgactgactctaacgttatcgataaagttgcactggtctatggccagatgaacgagccgccgggtaaccgtctgcgcgtagcactgaccggtctgaccatggcggaaaaattccgtgatgaaggccgcgacgtttctgctgttcatcgataacatctaccgttataccctggccggtacagaagtttctgcactgctgggtcgtatgccatctgcggtaggttaccagccaacgctggcagaagagatgggtgtgttgcaggagcgtattacctccaccaagaccggttcaatcacctccgtacaggccgtttacgtccctgcggatgacctgactgacccatcaccagcaactacctttgcgcacttagactcaacggtaacgctgagccgtcagatcgcctctctgggtatctacccggccgttgacccgctggattctaccagccgtcagctggatccgctggttgtcggtcaggagcactatgatgttgcacgtggcgttcagtcactgctgcagcgttatcaggaactgaaagacatcatcgccatcctcggtatggatgagctgtctgaagaagacaaactgctggtggcacgtgcgcgtaagattcagcgcttcctgtctcagccgttcttcgttgcagaagtattcaccggttcaccgggcaaatacgtgacgctgaaagacactatccgtggctttaaaggcatcatggaaggtgagtttgaccacctgccagagcaggccttctacatggttggcgccatcgaagaagccgtggaaaaagcgaagaaactgtaataacggtttcccgggaggaagattatggctatgacttatcacctggatgtggtcagcgcagaggagcagttgttctctggtctggtacagaaaattcaggtgtcaggtagcgaaggtgaactggggattttccctggccatgcgccgctgctgactgccattaagcctggaatgatccgtatcgtgaaacagcacggcgaagaggagtttatctacctctctggcggcgtgctggaagtgcaaccgggcagcagcaccgtttctggccgataccgctatccgcggtaccgatctggacgaagcgcgcgctctggaagcaaaacgcaaagcagaagaccatatgaacagcagccacggcgacgtggactatgctcaggcctctgccgagctggcgaaagccattgctaaactgcgcgtgatcgaactgaccaaaaaagcgatgtaatccagctttatgcgtcatgaaatgccagccctcgggctggcattttttttgtctgctgcgcctgatctgcctgtccgcctaatttcggcctgagaaaaatgtagtaatctcaatcccaaaccgttttactttcacccgtaaaaattcactcaggatagttatgtctaacagtgcgatgagtgtggtgatccttgctgctggcaagggcacccgtatgtattccgatctgcctaaagttctgcatacgctggcaggcaaacccatggttcagcatgtgattgacgcggctaaagggctgggcgcacagcaggtccatctggtttatggtcacggcggcgatcgcctgaaggcgaccctcactgacagcacactcaactgggtgctgcaggccgagcagctcggcactggccatgcgatgcagcaggcagcgcccgcattcgcggatgatgaagatatcatgatgctttacggtgacgtgccgctcatctctcaggcgacactacagcggctgcgcgaagcaaaaccgcagggcggcattggcttacttaccgtggtactggacgacccaaccggttatggccgcattgtgcgtgagaaacgacaccatcaccggcattatcgaacagaaagatgccagcccggcgcagctcaccattaaagagatcaacaccggcattctgatcgccaacggcggcgatttaaaacgctggctggcgcagctcaccaacaataatgcgcagggtgagtattacatcaccgatattatcgcgctggcgcatcaggaaggtcgggtgatcaacgcggttcatccggcacgcatcagtgaaaccgatggcgtcaataaccggctgcagctggcgacattagagcgcacttaccaggccgaacaggcggaaaaactgctgctggctggcgtgatgctgcgcgatccggcccgttttgacctgcgcgggacgctgacgcacggacgggatgttgaaattgacaccaacgtcattattgaaggccaggtcacgctgggcgcacgcgtcagaatcggcgcgggctgcattatcaaaaacagcgtgattggcgatgactgtgaaatcagcccctattcggtgatcgaggatgcgaatctcgccactgcctgcaccgtcggaccttttgcccgtctgcgtcctggcagcgaactggccgatgccgcccacgtgggcaacttcgtcgaaatgaagaaagcgcgtctgggcagaggatcgaaagcggggcacctctcctatctcggtgatgcggagattggcgacaacgtaaatatcggtgcaggcaccattacctgcaactacgacggtgcgaacaaattcaaaactgtgattggcgatgatgtgtttgtgggctcagatacccagctggtggcgccagtcagcatcgcggcagggaccaccattgcggcgggcacgaccatcatgaaagatgtgacccaggccggtctggtctataaccgtaaagagcagaatcacaaagcggactggcagcgcccacagaagaaaaaataaatttttaacggcccgctttaatgcgggccgatgcagtgcagtgccaaaactataatccccactctctacaaggctcggggaaccggcaaagccggatatcaggtcgcatgacaacagaagtggcgaaaagccatgtagtcaggaaaacatcattatgtgtggaattgttggtgcagtagcgcaacgtgatatcgcagagattctgctggaaggtctgcgtcgtcttgaatatcgcggatatgattcggccggtctggccgtggtcgatcgtcaggggcacgtcacgcgcctgcggcgtttagggaaagtgcagaaactggcggaagccgctgaacagcaaccgctgattggtggcaccggcatcgcgcacacgcgctgggcaacccatggcgagccgtcggaagcgaacgcgcatccgcacgtctcagagcacatcatcatcgtgcacaacggcatcattgaaaatcatgagccattgcgtgctgaactgatcgcgcgcggttatgtctttgcctctgaaacggacaccgaagtggtggcgcatctggttcactgggagcagaagcagggcggttcgctgcgtgaagtcgtactgcgtgtgattccgcagctgcgcggtgcctatggcatggtgatcatggacagccgcgatccgtcactgctggtggcggcccgttccggcagcccgctggtgattggtcgtggcatgggcgaaaactttatcgcctcggatcagctggccctgctgccggtgacccgtcggttcatctatctggaagagggtgatatcgccgaaatcagccgtcgcgatgtcacggtgatcgaccgtgaaggcaacaccgtgacccgtgccgagatcgagtcgaacctgcaatatgatgccggtgacaaaggcatttaccgtcactacatgcagaaagagatctacgaacagcccatggcgctgaaaagcaccctgagcggtcggttcagccagggtcaggttgatctcagcgaactgggcgcgggcgcagaagcgctgctgagccaggttgagcatatccagattatcgcctgcggcacctcctacaactccggcatggtgtcacgctactggtttgagtcgctggcaaacctgccctgtgatgtcgagattgcctcggaattccgctaccgcaaatcagccgttcgcaaaaacagcctgctgatcaccctgtcgcagtcgggtgaaacggcagatactctggcggcgctgcgtctctctaaagagctgggctacctgggatcgctggcggtctgcaacgtagccggttcgtcactggtgcgggaatctgacctggcactgatgaccaaagcgggcaccgaaatcggcgtcgcctctaccaaagcgttcaccacccagttagcggtgctgctgatgctggtggcgaaactgggccgtctgaaagggatgtcagccgagactgagcatgagatcgttcatgcactgcaggcgttgccgagccggattgagcagatgctggcgcaggataagctgattgagaatctggcggaaggcttctctgacaagcatcacgcgctattcctgggtcgtggcgatcaatatccgattgccatggaaggggcgctgaagctcaaggagatctcctacattcatgcggaagcctacgccgcaggcgagctgaaacatggcccgctggcgctgattgatgcggatatgccggtaatcgtggtggcacctaacaacgaactgctggagaagctcaaatccaacatcgaagaggtacgcgcacgcggcggcctgctttatgtctttgccgatcaggatgcaggcttcagcgacagtgacggcatgaagatcatcccgttgccgcatgtcgaagaggtcattgcgcccatcttctacacggtgccgctacagttactctcctatcacgtcgccctgatcaaagggaccgacgtcgatcagccacgtaacctggcaaaatcggttactgtggaataaccgggtgggccccgtcgcgggcccactttgctctggccctctgtcatataactgtcatatttcgtacatttcactgtcatcaaactgtcctattttccctcctgcagcaatcacagattcttactaaaacggccccaagcctgacttttctcccctggagggaatatgacactgatgcgtagcaccgtagcccgaatcctcgccaccaccttcgccgtaagcgcggtatctgcttttgcggcaaccgatctcactggcgcaggcgggacgttcccggcgccggtttatgccaagtgggcagcagaatatcaaaaagccaccggtagcaaagttaactaccagggtatcggttcatctggcggcgtgaaacagatcatcgctaaaaccgtcgatttcggtgcgtccgatgcgccaatgaaagatgaagatctgcagaaaaatggcctgttccagttccctaccgtgatcggtggcgtagtactggcggttaacctgccgggtatcaagtcaggtcagctgacgctggatggcaaaaccgtcggtgatatctacctcggcaccatcaaaaagtggaacgacccggcgattgccaaacttaacccaggcgtgaaactgccagagaccaacatcaacgtggtacgtcgcgctgacggttcaggcacctcgttcgtcttcaccagctatctggcgaaagtgaacccggactggaacagcaaaattggtaaaggtaacaccgtcaactggccggtcggtctgggcggcaaaggcaacgacggcgtcgccgcgtttgttcagcgtctgccgggttcaatcggctacgtggagtacgcctacgccaaacagaataacctgacctacaccaaactcatcgatgccgatggcaaagcggtcgccccaagcgaaaccagcttcagtaatgccgcgaaaggtgctgactggagcaaatcgttcgcgcaggatctgaccttccagaagggcgctgatgcctggccaatctcgtcaaccacctttattctgatctacaaggatcaggctaatgcggccaaaggcgctgaagtactgaaattcttcgactgggcttacaaaagcggcagcaaaaccgccacagcgctggattatgctgcgctgccagagagcgtgactgaacagattcgcgccgcctggaaagccaacatcaaagacagttctggtaaagcgctttatcagtaattgaccgaccctgaccggacagcagtccggtcagactcaacgggcggcgtcatgccgtcctgataacttctgaagactgagacttctatggctgcaacgaagccggcattcaaagccccaggcaaacaaggtgacagaatttttggcgcgctggtcaggctggctgcgctgattgtcctgttactgatgggcggcattattgtctccctgatcatctcctcgtggcccagcatccagaagtttggtttcgcctttttgtggaccaaaacctgggatgcgcccaacgaacaatttggtgcactggtaccgatctacggcacccttgtgacctccattattgccctgattatcgcagtaccggtgagttttggtatcgcgctgttcctgaccgaactcgcgccaggctggctgcgtcgcccgctgggcaccgccattgagctgctggcggccattcccagtattgtttatggcatgtggggtctgtttgttttcgcgccgctgtttgccgaatacttccagacaccggtcaatgacgtgatatcgggcattccgattgtcggcgagcttttctccggccccgctttcggtatcggcatcctcgcggcgggtgtgattctggcgatcatgatcatcccttatatcgcctcggtgatgcgcgacgtctttgagcagaccccggtgatgatgaaagagtcagcctacggcatcggctgcaccacctgggaagtgatctggcgcatcgtactgccctttaccaaaaatggcgtgattggcggtgtgatgctcggactgggtcgtgcgctgggtgaaaccatggcggtgacttttattatcggcaacacctaccagctcgacagcccgtcgctgtttatgccgggtaacagcatcacctcggcgctggccaacgagttcgctgaagcggaatcgggcgtgcacgtcgccgcgctgatggagctgggactgatcctgtttgtgattacctttatcgtgctggcgatttcaaagctgatgattatgcggctggcgaaaagtgaaggagcgcgctcatgaccacaattgaaattcaggcgcgcgccgaaactggacgcatcacgccgtaaaatgcagtcctggcgcagcactaaaaataaaattgcgctgacgctgtcgctgctgaccatggcttttggcctgttctggctggtgtggatcctgttcaccaccgtatcgcgcggcgtggatgggctctcctggtccctgttcaccgaatcaacgccaccacccaataccgcgggcggcgggctggctaacgccctggcaggcagcggattactgattttctggtctaccttcttcggcacaccgctgggcatcatggcgggtatctatctggcggaatatgggcgcaagtcgccactggcagaagtgatccgctttattaacgacattctgctttcggcaccctcgattgtggtcggcctgttcgtctacacccttgtggtgtcgcagatgcagcacttctccggctgggccggggtgattgcgctggcgctgctgcaggtgccgattgtgattcgtaccaccgaaaacatgatgcgactggtgccagacagcatgcgtgaagcggcttacgcgctgggtacgcccaagtggaagatgatcgcgtctatcaccctgaaagcgtcggtctccggcatcatcacgggtgtgctgctggcgattgcgcgcattgcaggtgaaacggcaccgctgctgttcacggcgctctcgaaccagttctggagcaccgacatgatgcagccgctggcgaacctgccggtcaccatctttaagttcgccatgagcccgttcgccgaatggcagagcctggcctgggcaggtgtgctgattatcaccctctgcgtgctggtgctgaacatcgtggcgcgggtgattttcgccaaaggtaaacacggttaatttccggcgcggccctgtgcggcgccgtataagagagatgaattatgagtatcgcgacagcatcagccgataaaattcaggtccgtaatctgaacttctattacggcaaatatcatgcgctgaagaacatcaatctggatatcgctaagaatcaggtgactgcgtttatcgggccatcgggctgtggtaagtcgaccctgctgcggaccttcaacaaaatgtactcgctctatccggatcagcgggctgaaggggacattctgctggatggcgaaaacattctggcgactcagcaggatatcgcgctgctgcgcgcccgggtcggcatggtgtttcagaagcctacgccgttcccgatgtcgatctatgacaacatcgcctttggcgttcgcctgtttgaaaagctgtcgcgtgccgatatggatgcgcgcgtgcagtgggcgctgaccaaagccgcgctgtggaatgaaaccaaagacaagctgcatcagagcggttacagtctctccggcggccagcagcagcgtctgtgcattgcccgcggtatcgcgattcgcccggaagtcttactgctggatgagccctgctctgcgcttgatcctatctctactggccgtattgaggagctgatcaccgagctgaaacaggattacaccgtggtgatcgtgacgcacaacatgcaacaggctgcacgctgctctgaccatacggctttcatgtatctgggcgaactgattgagttcagcgataccgacacgctgttcactaaacccgcccagaagcaaaccgaagattatataactggccgctacggctgatctgacaggagatcgacatggataatcttaatctgaataagcacatctccggtcagttcaatgccgagctggagcatatccgtacccaggtgatgatcatgggcggtatggtcgagcagcagctgaccgatgcaattaccgctatgcataatctggatggcgaactggcgcagcgggtgatcgacggtgaccagaaggtcaatatgatggaagtggagattgatgaagcctgcgtgcgcatcatcgccaaacgtcagccaactgcgatcgatttgcgactggtgatggcgatcatcaaagccatttctgagctggaacggattggcgacgtggcggagaagatcagccgcacggcgctggagaagtttggtcagcaacatctgccgctgctggtcagccttgagtcgctgggtcgtcacaccgtgcagatgctgcatgatgtgctggacgcttttgcacgcatggatctaaatgaagcgatcactatctaccgtgaagataaaaaggtggataaagagtacgaaggcattgtgcgccagctgatgacctacatgatggaagatccgcgcaccattcccagcgtgctgacggcgctgttctgtgcccgcgccattgagcgtatcggcgatcgttgccagaatatctgcgaaatcatcttctatttcgtcaaaggtcaggatttccgtcacgttggcggtgaccggctcgatgaattactgtcgggcgatgacggcagcaacagaccttcctgataaatcttcttcctgcgcctgatcggcgcagggataagccttttcaattggtcacatcctgaactctctctataattgcggcacttttctttatgaggtgcgcaacgatgtccccttctccccaatctaagcccggcgtaacgccaggcaaagcgatgctggctgcggtcagcggttatgccatggatggatttgacctgctgatactcggctttatgctgccggctatcagtgtttcgctggcgctcaatccatcacaggcgggatcgctggtgacctggacgctgattggcgcggttatcggtggcatcgtatttggtcatctcagcgaccgctatggccgcatccgcatgctcaccgtcacgattctggtcttctcggtctttaccggcctgtgcgcggtggcgcagggctactgggatctgctcgcctggcgaacgctggcgggtgtcggtctgggtggcgaatttggtatcggcatggcgctgattgccgaagcctggccggcggagaagcgtaatcgcgcatcagcgtgggttggcatcggctggcaactcggggtgctgatggcggcctttatcacaccgccgctgctgactatcatcggctggcgcggcatgtttttggtcggcttgttgcctgcgctggtctcgtttgccattcgtcgcggcatgggtgaaccggaggcgtatcaacggcaggttaaacatgtgccgtcactctcttttccggcgcgcctgaaactgctggtgcgcgatcgcgccaccgccaaagccagcctgggcatttttatcctctgttcagtacagaactttggttactacgggctgatgatctggatgccgagttacctctcctccagctttggcttcagcctgacgaagtcgggcctctggaccgcggtgaccgtggtcgggatgacctttggcatctggctgtttggcgtactggccgaccgcttcgcacgctggaaaatcttcctgctctatcagtttggcgcagtagtgatggtggtggtttatgctcagctgcgcgacccgaacatcatgttatttactggcgcgatcatggggatgtttgttaacggcatgattggcggttatggcgcgctgatttccgatacttttccgccgcaggtgcgtgccaccgcgcaaaacgtcctgttcaaccttggccgcggtgtgggcggcttcggcccggtggtgattggtctgctggcgagccagttctcatttacggcggcgattaccctgctggcgctgatttatctgctggatattgcggcgacgctgttcctgctgccgaagaaacagggtcaggaagatacgctgggcgcgatcggctgatgctgccgtgatggtatggctggagtaagtatcattccggccattccgggtcagtaatatggctcacgatcacctgttctgccttcattacccctggcattacatggcaggggggatccgttaacaggcgatttaaatccataacagacagagcgttctcgcaggtttacttcatcagcggcaggagctgttgataaagcgtcgcaaaggtctcccgacgcggctggtagtgtgctacccgggccggatccggctggtgtcgctgcaccagaaaccggggtcggcacggtgatctctgcatccagcgcctgctgcgccagcctggcggcccccagcgccgggccaacctccccgccatggcagtaatccagcgtctggccgctgatgtctgccagcatctgacgccacagtgcactgcgtgcgccgccgccgatcaacataatgctctttggctgaacgccacagtcgtgtagcgcgtccatgccctccgccagcgcaaaccctacgccttccagcaccgctctcgccagctcgggacggccatgctggtgggtaaagccaaaaaaagcaccccgggcattcgggttattgtgcggcgtgcgctcaccggaaagatagggcagaaaccacaggtcgggcacgtcatcgcgcgcgcgttcagcttcagccagcagctcaggaacatctctgcaaccggtcagcgtcgctgcccagtccagacaggaggctgcgctgagcatcaccgacatcagatgccagcgctggggtaacgcatgacagaagctgtgtaccgcgcgctgcggattgctgagatagccgtcgctcaccacgaagtagacgcccgacgtacccagcgacagcatgccctggcccggttcggtcatgccgacaccaatcgcacccgcagcattgtcgccaccgcccgccgccagcggcacggcgttcatcttccagcgtgtggccagttcggcatgtaaggtgccggtcagggcattgccctcatagagttgcggcatctgatcgcggctgaggtcgcaggcgcgcagcatcacatcgctccagtcacgccgtgccacatccagccacattgtgcctgctgcatctgacatatcagtggcgaagtcgccactcaatcgccagcgcaggtaatctttgggcaacagcacgtgagcgatctgattgaatattgccggttcatgttgctgaacccacagcagcttaggagccgtgaagccgggcatcatcaggttgccggtgatcgcccgcgaatccggcaccttctgttccagctcacggcactgcgcctcgctgcgcccatcattccagagcatggccggtcgtaatacctggtttgcactgttgagcagcgttgcaccatgcatctgtccgctcagcccgatggcctgcaccgcgcgcagatcctgctgcgcgctcagcgcctgcatggccaaatccagcgcctgccaccagctttcgggatcctgctcgctccacaatggctgcggacgcgaaacctgcagcggcgctgtttccgtcgccaccacgttgccttgtgcatccatcagcaccactttgacgccagaggtgcctaaatcgatcccgataaacatgctctgctcctgaagggttagaaatcaaacaggtagtgattcaccagattttccagctgctcctgacgtccgctctgatgctgcggattgagctgctgctgctgagcatgcgccgccagtgcctccagtgaaaactcacctttcaaaatttgctggccgaactcaccattccagccgctgtagcgctgtgccacacgcttatcgagttcaccatcgctgatcatgcgagcggcgactttcagcgccagcgccatggtatccatcgcgccaatatgaccgtagaagagatcgtatttatcagtgctctgacgacgcactttggcatcaaagtttaagccgcctgtggtaaagccgcccgctttgagaatttcgtacatcaccagcgcattctcttccacgctgaccgggaactgatcggtatcccagccgcactgcggatcgccgcggttggcatccacggaaccaaaaatgcccagcgcaatggccgtcgcaatttcatgatggaaagagtgacccgccagcgtggcgtggttcgcctcaacgttaaccttgatctctttctccagtccgaactgtttcaggaagccataaaccgtcgcgacatcatagtcatactgatgtttggtcggctcctgcggtttcggttcgatcagcagcgtttccctggaagccaattttgtgtttgtgctcgaccaccatctgcataaagcggccaatctgctcgcgctcctggcgcagatcggtattcagcagagtttcgtacccttcgcgtccgccccacaacacatagttttcaccgcccagggttttggtcgcctgcatggcgctgcagacctgcgtcgctgcccaggcaaaaacttcaggatcgggattggtggcagccccggctccgtagcgcggatgggtaaagcagttggccgtgccccacagcagtttcacgccggtctcctgctgtttctccagcagtttatcggtcatggcggcaaaattctctttgtagctgtgcagcgaatcgccttctggtgagacatcaatgtcatggaagcagtaccacggcacattcagcttgtggaaaaactcaaaggccacatccgctttcagttttgcctgctgcagcgcatctccgcttttctgccacggacgatcaaaagcgccgacaccaaacatatccgcgccattccagcagaaagtatgccagtaacaggcggcaaagcgcagatgctccgccatggtcttgccgaggatcacctcatcgggattgtagtggcggaaagcgagaggatgagtcgactgggtgccttcataacgaacccgatcgatctgatcgaaataagcgtgcatggtttgctccttagcatcagtacccgaatggcctgcgttgaagcaatatttgatattggctgctgcctcagctcaattacgatatttcactacgggtgtcagataattattatttgtgcgctggctcgcaaaataatgttatttacggggtggtttatcattatcgctctcttgtccgaaaaagatgaaacctcgatcgcgctcataaaaaatgaaataaaccaaaaaacgtaatagccggataaaaatcagtaattgctgtaacaggaaaataagggcaacaattcatccgcctggtttataggcctgaaacgacaatagcctcaacctacaggatgatcacaatgaagatgaaacatgcactgctcgccgcctgtgcggcgctggcgctgttcagccagaccagcgtggcaaaagaagtgaagatcggcatggcgattgacgatttgcgactcgaaacgctggcagaaagaccgcgatattttcgtaaaacaggctgagacgctgggtgcgaaggtgtttgttcagtcagccaacggcaacgaagagacacagatgtcgcagattgaaaatatgatcaatcgcggtgtcgatgtgctggtgattattccttacaacggtcaggtattgagtaatgttgtcgctgaagcgaaacgggaaggcattaaagtgctggcgtatgaccgaatgataaataatgccgatatcgacttttatatctctttcgataatgaaaaagtgggcgagctgcaggccgaaagcattgtgaaacaggtgcctaagggcaactattttttaatgggcggatcgcctgtggataataacgcacgcctgttccgtgccggacagatgaaagtgttaaaaccctatattgataacggcagcattaaaattgttggcgaccagtgggtcgatgcctggctgccggaaaatgccctgaaaattatggaaaatgccctgaccgccaacggcaaccatatcgatgcggtggtggcctctaacgatgccaccgcaggcggcgcgattcaggcgctgagcgcgcaggggctggcaggaaaagtggcgatctccggtcaggatgccgatctggcagccattaagcgtatcaaagcgggcacccagaccatgacggtttacaaaccgatcactgagctcgccaccgaagcggcgaaaattgccgtcgagctgggcgagggcaaaacacctgccagcaacagcacgctgaataatggtctgaaagaggttccgtcacggctgctgaagccgattccggtcaacaaagacaatattgaaagcaccgtggtgaaagacggtttccacaaacagagcgaactctgactgcgcatagcgtgagggagaacagtcgatgctgctggaaatgaaaaatatcaccaagcgtttcggtgccgtgaaggcgctgaatgatgtcagcctgcaacttgaggcgggcgaagtgatgtcgctgtgtggtgagaatggctcgggcaaatcgacgctgatgaaaatcctgtgcggactctatccgcacggcgattttgaagggcagattcacttctctggcgacgacattcaggcgcagaccattcgcgataccgagcgtaaaggcattgtgattattcatcaggagctggcgctggtgcggcaactgacggtgatggagaacattttcctcggtgccgaaactgagccgtttcggcatggtggatgatgaaactatgaccctgcgctgccagcaactgctggcgcgggtcgggctgaacgtttctcccgccacccgggtcggtgagttaggccttgggcagcagcaactggtggagattgcccgcgcccttaacaaacaggtccggctgctgattctggatgagccgacctcttccctgacggagcaggaaacggacgtgctgctcggcatcatccgcaatctgcgtgaacacggcattgcctgcatctacatctcgcacaagctgaatgaggttaaggcgatctccgataccatctgcgtgattcgtgacggccagcatattgctacccgtccggcagcgggcctgagcgaagatgacatcatcaccatgatggttggacgcgagctgaccgcgctctatccccacgcgccgcatcagattggcgacgtgatactgaaagttgaaaacctcaccgcctggcatcctgttaaccgccacatccgccgcgttaacaatgtctcgttctcgctcagacgcggtgaaatcctcggcatcgccgggctggtgggcgcgggcaggactgagacagtccaatgtctgtttggcgtctggccaggacgctggcagggcgatatctggatcaatggcaaacaggtcaacatcaccgattgccgcgccgccattgcgcacggcatcgcgatggtgccggaagatcgtaaaaaagatggcatcgtgccgctgatggcggtgggcaaaaatattaccctggcggcgctggaccagttcagccaccggctctcaacgctggatgaagcgcaggagcagcaggcgatcaatgacgcgatcggtcggctgcgggtgaaaacctcctcatcagaactgccgattggccgtttaagcggcggcaaccagcagaaagcgattctggcgaaatgtctgctgctcaatccaaaaatcctgatccttgatgaaccgacgcgcggcattgatgtgggcgcacgtcaggagatctacctgctgatcaatgcactggttcagcagggtatcgcggtgattgtgatttcctctgagctgccggaagtgctgggcctgagcgatcgggtgctggtgatgcatgaagggcagatcaaagccgatttgattaacgataacctgactcaggagcaggtgatggaagctgccctgcggagtgaacattatgcttaaaagtgaaagtacccaaagccgcctctccggcacgccgggcaaaccgtcaccgggcaggttcacactgcctaatctgcaggttctggtgatgctgggcgcaattgtgctgattgcattgttctttacctggaccacagacggcgcgtggctcagcgcgcgtaacgtctccaacctgctgcgtcagaccgccatcaccggcattctggccgtgggtatggtgttcgtgattatctcggcggagatcgacctgtcagtaggttccatgatgggcctgctgggtggcgcggcggcgatatttgacgtctggctcggctggccgctgccgctgaccattgtggtgacgctggtgatgggattactgcttggcacgtggaatggctggtgggtggcctaccgtaaagtgccttcgtttattgtgacgctggcggggatgctggctttccgcggtgttctggtcgggattaccgatggcactacggttgcgccgatcacgccgggcatgtcgcagattggtcagagttatctgccgggcggcgtcggtttcggctttggctttgccggtctggcgttatttatgttgtggcagtggcggctgcggctgcgtcgtcagcagctcggactggcgcagggcgcagccagcggcaccatcgggcgtcaggcgatcaccgccatcttagtgctgggtgccatctggttgctcaacgactatcgcggcgtgccaacgccagtgttactgctggcagtgctgttgctggcgggcatgtttatggcaacccgcaccgcgtttggccgtcgtatctacgccatcggcggcaacattgatgctgcgcgcctgtctggcattaacgtggcgcgtaccaagctggcggtgtttgccatcaacggtgtgatggtggcgattgccgggctgatcctcagttcacggctgggcgcaggttcgccgtcggcgggtaatattgcggaactcgacgctatcgccgcctgtgtcatcggcggcaccagcctggcgggtggcgtgggttttcggttgcgggcgcggtaatgggagcctttattatggcctcgctggataacggcatgagcatgatggatgtgccgactttctggcagtacatcgtcaaaggcgcgattctgctgctggcggtgtggatggatacggcaacgcggcgtcgggtgtaatcgcgcgggcgatcacattgtggcgcaaacaatttttttgcccctttcagccgtgttatgcaatgcgctgaggatttaagggaacgcgccatcatgcatgagaaacgctatcgcattaccctgctgtttaacgccaacaaagtgtatgaccgtcaggttgtggagggcgtcggtgagtatctgcaggcgtcgcagactgactgggatatcttcatcgaagaagatttccgctgccgcatcgacaacatccgggagtggctgggcgatggggtgatcgccgattacgacgatcgctctatcgaaaccctgctgtcgaatgtttccgtgccgattgtcggcgttggcggctcttatcatcggcaggaggattatccgccggtgcactacatcgcgactgacaacgccgcgctggtggagaaagcctttctgcatttgaaagagaagggcattaatcgctttgccttttatggtttaccggcctccagcggcaagcgctgggcacaggagcgtgaacaggcgtttcgccagctggtgggacgtgagcgctatcagggcgtggtctaccagggcatggaaaccgcgccggaaaactggcagcacgcccagaaccgtctcgccgactggctgcagacgctgccgccgcaaaccggcattatcgccgtcacggattcacgggcgcgacacctgctgcaggcgtgcgaacacctgaaaataccggtgccggagaagcttacggtgatcgggattgataatgaggagctgacccgctatctgtcacgcgtggcgctctcgtccgtggcgcagggctcgcgacagatgggctatcaggcggctaaactgctgcatcggctgctggataagcagcccttaccgcttcagcgcatcctggtgccgccggtgaaagtcatcgcccggcgctctaccgacttccgctcgctgcgcgatccggcggtgattcaggcgatgcactacatccgcttcaacgcctgtaaggggatcaaagtggagcaggtgctggatgccgtcgggctgtcgcgttctaatctggaaaaacgctttcgggatgagaccggcgacaccctccatgcgatgatccaccgtgaaaaactggaaaaagcgcgcgaactgctggcctcttcatcgctcaacatcaacgagatctcgcagatgtgcggctatccttcgctgcaatacttctattcggtcttccgcaaaagctacgacaccacgccaaaagagtatcgccagcattttggggagaatgtgttgtagcaggaagcgttcagtctgaggtggatggaaaccggatgaatcagggcggcttgagccactagattatccgctgctcactctgctccagcaccgccagcgccagcccgttggccggatctatccgttgctcaggaaagtgcagcagggtatgtgcggcggtaaaggccagcgcgttgccgtgggcggtagtgcgcaccgccttgcagaagacctcactggcgttccacggacaatcaatgatgatggtggcgggattgagcagcagcataatctgactcagcgccgcacccagatagccacccgcctgcgccatcacctcatccaccacccgtggcgcgctgtcgcggtttctgccagctcaggccaggctgacgctgcgccagctgctgtttaaccgcaggctggctgaccagcgcttccaggcaaccgcggcggccacagctgcaacgcgggccgtcgggctggacaaccagatgtcccgcctcgcccgccgtccagctgtgcccggtaaatacttcgccatgctgtaccagtgcgccgccaattccctcggaaatacgcagataaaagtgaccgctctccacagataatccacgtagctgtaccgccagcagcgcagcggctttgacattattcataatgcggatggggagactgacgtgcttactcagcgcgcccagcaggtcaacatcctgccattcgaggggcaatgaaatatgcatccagccgcgccggggatcgacgataccgggaaaacccaggccaatgccgagcaaatcaggatagcttttcatcagttcccggcacagcatcgccagctcagccagcagtcgggtcgggttactggtatcggtgcgcagcgtcttttcagccagcacctgtgaaaaatagtcgcagacccgccagtggataacgttgcgttccaccatgatgcctgcgctcttgagcttttccggccgcagggtaatcccgattttaggccgtccggcggacgcgacgctgaccggccccagctcctctatcaggccctgctccagcaggtcatcaatgattaatgagacggtatttttgctgagtgtcagcgtctccgccagatcctgacgcgacgtcacgcgcagcttgcgcagctgagtcatcacccgtttctggttattcagtcgcagtagtgccgggcctttgccgttcgttttcattacgggttcactcaacagaggagtaagaattgagtgtatcagcccatacgtattccacatcccacacttttgcgggcggtttcacacaacccgatcgcctgtggctaagatcgtgaccgcgatcagatcgtgggattaacgccgggttttctgctgcaccagtggccggacgtcggaatgatcctgactcagcgcgtccggctgcgccgggcatgggcggaaggtcaaaggcggtgtagcttgtcgttatgaagaggggcttcaggcttgatgagcgcagtgacccggcgctgccgggtcactgtttaatattcgtcgccgcgtacccgactgcgatagctttcccagtcgaagcgcacccacaggctgttgccgaggcgcatacggtccatgacacgttcgcccagcagcgtattcatgcccgcatggtcgaggttagataacatgccggtcgggcgtttcgaggaggatcggcgatcgacaatctggttaataatcactttttcgtagcgcgattcactctgcataccgatctcatcaatcaccagcagatcaacactgctgagatcctgaatcagccgctcttcggtaatgccgctgctgccgctgaaggtgcccttcatgctcgacatcagatcggcaactgtcacgatcagcacgcttttaccgcgcaggatcaggtcgttgccaatcgcggcggccagatggtttttaccggtgccgggacggcctgaaaagacaaaactggcgatgctgccatcaaattcagcggcatactgacgcgccagttccagcgccttgcgctgtccctcattctctacccggtaattatcaaatgagcagttcatatgcagctctcgaatgccggaaacggcccattacgcgctgcattttcattgcgcgattctcacgcacaatcgcctctgatcgcagacgaccctgctcctgattccacgccagtagctcttcgccattggcaaatttaggacgggtgcctgcgggcatcatttttttcagacggttaaagagatcgtttggcgttttcatcattcacctcggaaaccatcgggaatggtacggtcaggatcgggcaactgcgtgatatcacgcttcggttgcccgccgtttgcggcacggttcatctgaatgctgcgtgccagtttctgttgccactgtacatgatggaacatccggccttccgcctgccagtaagccacaaaggccgccagctcgctgggggtcaccggttcgcccagcgacacaccccagatcgcggcctggcgcgtaaagtcggcatccggctgccagccctgatacatggcgaacttacctgccggcgtatggatcgcggcgggggaatcgtcatacaggctgtcatccagcgccacatcattcggctgccgggcggcggcttccagcgccagcagctcagccagacgcttaggtgtgatggcgtacatcaccggcgcataattatctaacaccgccagcgtgcccttttccgcctgctgcagggcagtcagcggatcctgtcggaaggcatccaggccaatgagcgttgaagttaagattttagctgacatgaaaagacctgaggttaacgaacaccttgcgccgggaacccgtcgccgacgcagaagtgtttattgtaccttttttaatgatgcggatcgcttaaaaagcaagagtgcggatcagtgcgaggtgaccggagaagtggcgtgacgggccggtgcagattcggtggcgtgcacgctgacggcagcggcggccggacgggtctgccataaatagcgaaccgaggccagccagcacaggccgtaacccagcagttcggtgccctcttcggccatgtttttcaccacgcggttgtaatctcccagcatcaggtgctgccacaacgcatgaataccaaacagtcgtgagaagaccagcaccactaaaaagccggaggccatcaccggccagctgcggtgctgcagcagcctggccagcgcatgcagggtttttttcggcgttcgcagcgcgacggccagacaaccggccgtcaccgccagggcgaaccagatccagctgccatgctggatggcatcaaacacaaagtcgagctcacggatcagcatacagctatagaagcccgccactaaggtcagcgcgccgcgctgagccggacggcgctgggccgcaataaagaacagggcggcaatcaccgccagtatgatttcctgggtggtttcagtaaaagaagtttcgtgcagcgcatcattcatccaggccacatcaatatagatgggcaatatcatcagagcgagaaagagtgctgccagtatgaagaccgtcatttcacggccaataattgtcaaatcgttgcgcatagtgttaccagtataatgattagcggactcattatattttaaacgcccgattccctttctcttttcatgccccggtcagaagctggcgctgaagccaaaggtataaagttgctgctcctggttattcagcgcttcgctttgtgaaaacgcggcgaaagccgccagattatcgttcagaggcacttgtgcaccgatgctcagatcgatgccttcggactgatcggtgccgtttcgtcgcctcacgccggggattctgcggcgtgtctgccagcagatagtgataactcagctgcgcccagggcgatatccatccctgctgcgaatcgatgcgccagccgacgctggcgctctgctcacgactctgctgatcgctgtagtcacattgaagacagttcatctgctgcggatcaacggcatactgcgccaccggcccggtggtaaatgacggggcaatgggcaggtcaaccccagcccgatagcgttttcccagcggggtggtgcctacgctgccggtttcactgtggacggcgatgggtgacgcggtgggagagttgatggcggcttcaaacagggcgcggctctcatcgctgaaggcgagtggcgtcagggcgatcttctccgccagaatcgtatcgtagtcgggcagaaagtcgggatgttgaggcgcagagatgccgccgcgcgcaaaagtcggttgcgttaagattaacagccatacagcacagcagatccgcagacctttccaaccgcttctcggcaacatcgcttctccaggcaaggctgaagttattatccggcgtttaaattaaatttcggcccgtctctgttatttaaccggtgatcgtttaactatcaaccgattaattctaagatcaagcggaccgctaaaatattcttgttataaaggaacaaagcgatgcaacgatgtggttgggtaacgcaggatcccctctatctggcttatcacgacagggagtggggtgtggcacagagagacaagcgtgcgctgtttgagatgctctgtctggaaggacagcaggcggggttatcctggataaccgtgctgaaaaagcgggaaaactatcgggcggcgtttcaccagtttgatccgcaggccattgcgttgatggatgcggcagagatcgacacgctgatgctcaacagcggcattatccgccacgccggaaaaatcgcggcgattatcgccaatgcccgtgcttatctccagatggaagcgcaaggcgaggatttcagccacttcgtctggcaatttgtcgataacgcgcaaatcgtccaccattatcctgactatagtcaggctcccaccacctcagagcaggccattgcgctctcgaaggcgctaaagcagcgtggtttcaaattcatcggccccacaatctgctactcctttatgcaggcctgcgggctgataaacgatcatcagagcaactgtttttgccatcctgacaaccaaaaggcgtaattcccgctaaatcaggatttttcctcactacattcccggccaccaggcggcataatcgtgccacttatgggaaaggttttcccctgtgtgtcgaatgtaagggaacaaaaatgcagaagaaattaatcgccatcaccttgttattaagcggcagtctggccctgccaggttgtaccaccaatccttacaccggcgaatctcaggcgggtaagtcaggtgtaggcgcaggcctgggtgcgttagtgggtgccggtgtcggcgtactctcctcgtcgaagaaagatcgccgtaaaggtgcgctgattggtgctgctggcggagccgcactgggcggtggcgtgggttactacatggatgtgcaggaagcgaaactgcgcgacaagatgcgcggaacgggcgtcagcgtgacccgtaatggcgataacatcgtcctgaatatgccaaacaatgtcaccttcgactccagcagcagcaatcttaaacctgccggcgcgaacaccctgacaggtgtttcaatggtgctgaaagagtatccgaaaaccgcggtaaacgtagtgggttataccgacagcaccggcacccgcgcgctgaacatgcgtctgtcacagcagcgtgctgaaagcgtcgccagcgcgttgatcgtgcagggtgttgccagcgatcgcctgcgcacccaaggtgcaggcccggataacccggttgccagcaacagcaccgaagcaggcaaagcacaaaatcgtcgtgttgagatcacgctcagcccgctgggataaacgcggtcgcccccgcccgggggcgccttttttctgtaaagcatcgcgttaaaagtatcagtaatgtttctgcgaatagagccagcagaggctttatggtagtctgatcaaaaattgatcaatggacgccttcccatgtctcttaaagccatcgctgcggttttaggtctttccgtaacaaccgtcagccgcgccctcaacggttatcaggatgtcgctccggagacgcgtaaacgcatcgaagaggaagcgcagcggcgtggctaccggcctaatgcggcggcccggcgtctgaaaaccggccgtgctaacgcggtggggttcgtctacccgatcggtgcctctcccctgaatggcagcgacttcagcgacatgctgctggctctggagcatcaccttgcccgttatgacattaacctgctgttgctggcggataagcagcagagtcaggcgacgctgacacgcctgctgcgcagtggcgccgttgatgccctgatcgtcggccacaccacgccagaagacagtcggcttcatgctctgctccagaccaattttcgttttctggcgctgggccgcagcgatctgccatcgacctatgcgtggtttgatgttgatcaccttgccggttcacagctggcggtgggctggtcgctggcgcagggacggcagcggatagcctggcttggcagcaatgaaaacagtacgcgggtgcgtgaccggcgtcagggttatctgacggcgctgggggaagttacgccttacgcgatggcggcggtggcaccgtcgcgccgcgccggttatcagcaaacccgggagtggctggcagaggggccagtaccggaagtgatcatcaccgactgcgctgcgctggctgaaggcgcggctctggcgctgcaactggcggggcgtgcagcgggcgagggtgccattctgctggcgggctgggaaggattgccgcgagatgcgattctcgatcatcccattgtcgccattcgtcaggcgacgccgcatcaggccggtgaacaggtggctgaaatggtcatccggctgattgatggcgcaccgccggaaacgttacagaccctgtggcaaccctggctgcaattaccggcgtagcgctttttgcgccgggctttgcttgtgctagtctctgccgggtttcttattacgcaggatatctcatgaaaatcaggccgcctcgcgccaccatcagcgatgttgctcacgcggcacgaaccggtaaaaccagcgtttcacgctatctcaatggtgaactgcatctgctctctgccggtctgaaagcgcggatcgaacaggctattgctgatctcagctatcgcccgagtcagatggcgcgcggcctgaagcgcggacgtacccgcctgatcgggctgattatcgccgatatcaccaatccctattctgttgatgtcatgagcggtattgaagccgcctgccgcgagcagggcttcacgctgctgatgtgtaataccaataacgaagtggatctggagcagcactatctgcaattgctgagcagctatcaggttgagggcattgtggttaacgccgtcgggatgcgcgaagaggtgctgaaccatctgcaacaatccctgctgccaatggtgctgattgaccgtaaaatccccgattttccctgcgatgtggtaggcctgaataacgccgaggcagctgaaacggcaacgcggcatctggtcgacaatggctatgatgcgctgctgtttcttagcgagccgctgggaagcgtcaacacgcgccgtgagcgcctgcaggccttccgccagctactggcagagcatccgcaggttgagcatgagaatacggaagtggcgctgcatcagcccgccgcgctggatcaggcgctgctggcctttcatcagcgtcacaccggcaaacgttgcgcagtgatggtcgccaacggggcgctgaccctgcaggtagcgcgatcgctacaaagactcaatctgcactggggccgcgatatcggcctgctcggttttgacgaaactggagtgggcggcgctggccggtgtcggtatcaccacgctgaaacagcccacctggcagattggctacagtgcgctggaacgactgattacgcgcatcgaaggcagcggattgccggttgccgagcaggtcttttctggcgaacttatcgttcgcggctccagccagcctcttaactgaatttcagatttaaccttccgtttacgtgctcgcttcgtgagcacgatcataatttcacagtttgctgctttgctttggaaccggttccatttagggtttttgtattcgttatgggcagaaccctgccatggagtagaacatgaaacctgacatcatcgtggtgaccgccgcatatggccacgcacagatcgccgctctcggcggtcagcgtgcgctgctgccgattatccagcaggcgggcgcagacggggtcgaaatccgccgcgaaactgcttgatgacgcggcactggccgatctgccggcactggcccgggcggtggcgcagcatcagctgcacagcagctattcggtgcccgatacgctgttttgtgacggcggcgaaatcaatccccgtataacccactacgttgaagaagcacgccagttaaacgctcagcggctgaaagtggcgctgggagagttcaccggtgcgctgcctcgtgaagcgttgcaggcgctgctggcggatctgccgtttcagctgacggtagaaaacgaccagactgagcatggccgactggctccgtcagtcgcctttttcacggcggtcagggaagcggatctgccgatcagcatgacctttgatatgggtaactggtgctggaccggtgaggatgccgatcaggcggcgcagcagctggctgcgcaggtgggctatgtgcatgtcaaagccgccgtggcgcaccaggatagctaccgcgcgattgcgctggatgaggctgatgaccactggcgcacactgctgcaacagttgcccgcacaggcagcgcgcggtattgaatttccgctggaaggcgacgatctgactgcggtgacacgccactacgtgtcgctgctgcgtaacgtgtaaggagtgaagatgaccacgcatcacactatgcatcacaacggtccgcttgatgttgtcactatcggtgaagcgatggcgatgttcatcgcccgtgaaaccggcgacctggccgcagcagagacctttgttaaacgcgcggcgggcgctgaactcaatgtggcgaccggcctggctcgtcttggcctgaaagtgggctgggtcagtcgtattggcgatgacgcttttggccggtttatctgccagcagctggaaaaagagggtatcgaccacgcccgggtgacggtcgataagcgctatcccaccggttttcagctcaagtcaaaagtcgacgacggctctgatccactggtggaatattttcgtaaaggctcggcggccagccatctgtcggtcgacgattttgacgcggactattttggttcggcgcgacatctgcacctgagcggtgtggcagcggcgctgtcagagagttcgctggagttgctgaagcacaccgccaaagagatgcgcgcgcgcggtaaaactatctcgtttgaccctaacctgcggccggtactgtggcgcagcgaagaggagatgcgtaagcagctcaatctgctggcggagtatgccgactgggtactgccgggcgaaaaagaggggctgattctgaccggctatcgtcagccagaagcgatcgcggatttctatctcgataagggtgtgaaagcggtcgtgattaaaaccggttgtgacggtgcctggtataaaacggcgcagggcgagcagggccaggttgaggcgataaaagtcgacaacgtggtggatacggtaggcgccggagacggctttgccgttggcgtcatcagcgccctgctggaaggtcagtcgctgccgcaggcgattcgtcgcggcaacaaaattggttcgatggcgattcaggtcattggtgacagcgaaggtctgccgacgcgtcagcaactgggcgacgtgtagttcgcgcccctctacagtcacaggagttcccgatgaaaaagcagacaatcgcgccaaaacgctggtggttcatcatgcccatcgtgtttatcacctacagcctggcgtatctcgatcgtgcaaattttagcttcgcttctgctgccgggattaatgacgatctcggcatcaccaaaggtatgtcctcgctgctgggtgcgctgttcttcctgggttacttctttttccagatcccgggtgcaatttacgccgaacgccgcagcgtcaagaaactgatcttctggtgcctgatcctgtggggcggctgtgcctcactgaccggcgtggtcagcaacattccgatgctggcggccattcgctttattctgggcgtggtggaagccgcggtgatgcccgcgatgctgatctacatcagcaactggtttaccaagtcggaacgttcacgcgccaataccttcctgatcctgggtaatccggtcacggtgttgtggatgtcggtcgtgtcaggctatctgatcgaatcgtttggctggcgtgagatgtttatcttcgaagggattccggcggtggtctgggcgatcgcctggtggttcctggtgcaggataagccggcgcaggcgcgctggatgagcgatgccgagaaagcggcattgcaggctgaactgcagaaagagcaggaaaatattaaagcagtgcgcaactacagcgaagcgttccgcaaccgcaacgtgatcattctctgcctgcaatattttgcctggagcatcggcgtctatggctttgtgctgtggctgccgtcgattctgcgtaatggcacgcagatgggtatggtagaagcgggctggctctctgcggtgccttatctggcggcgaccattgcgatggtggtggtctcctgggcgtcggataaaacccagaaccgtaagctgttcgtctggccgctgctgctggtgggcgcgctggcgtttcctcggctcttatctggtgggatcgaacaatttctggatgtcctacaccctgttagtgattgccggtgccgcgatgtatgcgccttacgggccgttcttcgccattattcctgagatgctgccacgcaatgtcgccggtggcgcaatggcgctgatcaacagtatgggtgcgctggggtcgtttatcggttcatggattgtcggctatcttaatggagccaccggcagcccgtccgcgtcctacatctttatgggatcggccctgctggtttcggtgtggctgacgctgattgtgaaaccggcgcagaacaaagcgccgccgctgcagggtgcgaaacccgcctgaaagcgtaaacgttagcctctatttctccgggcggcctgcaagccgcccgctacttattgaccgggagccaccgaatgaaacccgctgtaattctctataaaaaactgcccgacgatctttatgctcgcctggctgaacagtgtgacgtgacggaaatcagcgatctctcgccggaaagccagcaggaacatgctgcggcgttccagcaggcagaaggtctgctgggatcgggcggtaaagtgaatggcgagctgctggcgaagatgcccaatctgcgcgtctgctccagcgtctctgtaggctatgacaattttgatgtggatgcgctgaatcagcgtcacgtggtgctgatgcacacgccgaccgtgctgaccgaaaccgtggcggacaccatgatggcgctggtactgagcaccgcgcgtcgggtgccggaactggatgcctgggtcaaagcgggcaactggcagaagagcatcggtccggcgcagttcggcatcgacgtgcaccataaaacgctgggtattctcggcatgggacgtatcgggatggcgctggcgcagcgcgcccactttggcttcggtatgaaaatcctctataacgcccgccgcgagcatgaagaggcgcagtcgcgctttggcgcacagcgctgtgaacgggaggcgctgctgaagcagagtgatttcgtctgcatcagtttgccgctgactgaagagacgcaccatctgatcggtgccgccgagcttgaactgatgaagccggatgcggtgctgatcaacgccggtcgcgggccggtggtggatgagaatgcgctgatcgccgcattgcaggcgggcaaactgcatgccgccgggctggatgtgtttgagcaggagccggtctctgccgactctccgctgctgtcgctgcccaatgtggtgacgctgccgcatatcggttctgccacccacgaaacccgctacggcatgatgcaggatgcggtagaaaatctcctcgctgcactcggcggaagcgtcgagaaaaactgcgtgaacccgcaggcgctgaagtaatcccctcgcctttccattgcgcccgcccatggcgggcgttatggtggacccccgattcgctatcacaaatatttaaccgctatgtctttttctcagttcggcgacaaatttacccaacattccggcatctcacgtctgatggaagatatgggcgcgggcctgcgaacgcccggcaccatcatgctgggcggcggtaatccggcgcagatcccggccatgaacgactactttcagcaactgctgcagcagatgcatgaggaaggcaaactcagcgaggcgctgtgcaattacgatggcccgcgcggtaaagcgacgctgctggcgtcgctggccgggctgctgagcgatgagcttggctggcccatcaccgcacagaacattgcgctgactaacggcagccagagcgctttcttctatctgttcaatctgttcgccggtcgtcgggccgatggcagcaaaaagcgggtgctgttcccgctggcgcctgagtatcttggctatgcggatgccggcctggaagaggggctgtttgtatcggcgaagccgaacattgagctgctgccggaaggtcagtttaaatatcatgtcgattttgagcatctgccgatgaatgaagaggtcgggctgatctgcgtatcgcgcccgaccaaccccaccggcaacgtgatcaccgatgatgaactgatgcagctcgatgcgctggcacagcagcatgacgtgccgctgctgatcgacaatgcctatggcgtgccgtttccccggcatcatcttcagcgaggtgcgcccgctgtggaaccccaacatcattctctgcatgagtctgtcgaagctcggcctgccgggtgcgcgttgcggcatcattatcgctgacgagaagaccatcaccgcgctgagcaatatgaacggcatcatcagtctggcacccggcagtatcggtccggccattgccaatgagatgatccgtcgcggcgatctgttgcggctctccgaagaggtgattaagccgttctatcagcagaaggtgcagcagaccattgcgatcctgcggcgctatctgccggaagaccgttgcctgatccacaagccggaaggggcgattttcctctggctctggttccgcgatctgccgatcaccaccgaattgctttatcagcggctgaaagcgcgcggcgtgctgatggtgccgggccacttcttcttcccggggctggaacaggcgtggccgcacacccatcaatgtatgcggatgaattacgtgccggatgcagagaatattgagcgggcggtgcagattctggcggaagaggttgagaacgcctggcgcgacagctaatcctgcgtatcggttaacgacagctggcaccactgtgccagctgctgaatcgcctgttccacctctgcattccagccaaaaccggcattcagccggaaacagtgatcgtagcgctggtcggtggcaaaaatgtggcccggcgcaatgccgatgcccgcgttgcgcgctttcagaaacagctcgcgcacgttcagcgcctgtcggggcatctcaacccacagcacatagcctccttccggatcggacacccgggtccccgccggaaattcccgtaacactgactgacgcatttcacggatttgtcgtgccagctcacgccgcagcttacgcaggtgagcatcatagccgccgctgcgcagcagctccgccaccgccgcctgcgacagcaccgaggtgcccatggttgaggtatatttcagtgaggcgattttgcgcatgtagttgacgctgtgaacccagccgatacgaatgcctggcgccacggttttagagaagccgctgcagagaatggcgttggggctgaaggcgcgcatcgggaaagggcggcgttcaccaaaggcagtatcgccaaaaatatcatcctcaataatcaccacgtcgttttcatccgcctgccgcgcaatataggccttatgctcgttgggaatgctttttcccagcggattgttgacgttgcacagggtgagaaagacccgcaccgccttgcgctgaaacagcccggtgagcttcgcgacatcgacatacccttccggcccggcttccacttcaatcacccgtaaattgaggttatgcagcatctgcagcagcacgaaatagcagggtgattccacggcgaccacatcgcccggctgggtcgtggcgcgcagcgacagcgagatcgcctcaatgcagccgttggtgatcagaatatcgtcagcgctgatattgcagccgtaacccactgcccggcgggcaatctctgttttcagcggcgcatagccggtgcccttcaccgtattcccgagcagggccggtttgctgtagcccatctgacgcatcagcaggccgatgcgcttgaccggatagagcgcactgtcaccgttggccagatcgagacgcacccggcagtctgagccaagcatcgccagatggagttctgtctgctcatcaagcggcgcgatggcgcgcggctgttcactgacggcgggcaactgacgggaagagggccgctgcggagcaacaaaaaagcccgatttggggcgggcaacggcgtagtgctcatcttccagcgtgcgcagtgtcttcagggcggtggtgaggctgacattgtactgcgtcgccagcgtgcgcaccgacggcagacggctgtcaggtgccagcgaaccggcatgaatggcctgcttgatctgttctgcgatctggcggtaacgactgctctgactctccttttccccgataatatcggccatctgttccaccccatatcgcgctgatctgtgcatattcaacagagtacattcaaagtactttaggctgcatctcttaattattcataacgctaaacggcccggcgaccccgtcagccccgggcttcagaccataaagtgattctgttcacctgaggaaaacgtgagaaatgaataatctgcccgccatgatgaaggagatggaagcgtatctgtcacccgccatcattgagtctgctcagcgctgctctcttcgcctgctggcagcgttgccggatcagcagcagctggagaataaccgtgtgctgctcgcctatggcgggggaaaagacagcagctacatggtggcttacgtgcgttacattcagggactgatctggcagcagcagggcagcacctttcatctgcggatcagcaccaatcgccatgcggcgatgaatcagagcgtaatggagaatatccaccgcatttatcagtcgctggcgatgcatgatgatgaacgggtggagtgcctggtggtggatggcctgcttatccggccgtttgaccgcgacctgccgatgccggagagcatgcggcagcagaaccgtaatgatgtgctgatgaatggccaccggtttcgcgccgacgcgcgctcaaccttctgcaacgcctgtaatctcagcatggtgaactcctttggcctggcggcagactacaacggtggcgtggatctgattatcaccggcgactcgccacaggagcaggccgcctatgtcgcctgggcgcggcacctctcacggctgtttgatgcgccagtggcggacaaaacccggggcttcagcgggtttctgcagacgctggatggcgtggcagagcgctacttcagcgatgtttatggcgccgatcagctgacgcctgcgcaccgcatcacccaccagctggcgcgcaatccactgttcttcaacatctatcaggacaccgcctatgaagcgggcgcgcactgggcactgctcagcgaatttatgcgcttccgttttgatgcgctgatgttcagtttttccgaatccgactgcggtaatccgacgctgatggcgcacctgcgcggattgcgggcagaaacgctgctgcagcgccactatgccgaagggatccgcgaatatgtgcgctttgcgctgggactgatggtgaagaaagattttccgcccgcgctaatcgatgagatggcggcgcgctatcaggatgacgccgcgatccagcggcagcggcagcgcgcggcggacttcgccatacaggcgtttgacctcagcgaagatcagctgatctgcatgatctactccccgtttcctggcgcagggagagcagctcggacactggctgatgcagcagcagattacgctggatgaggcggccatccgcgacctgcttgagcaacgcagtgaagatcgcgcgctggcacagcagttaacccggctctccggcatgacgctgacgcagatgcggcactgttggcagagcaagccggtcagttcgctgctggagggcaaaagcgccgatccgctgtcgcgcgtgctgcgttttgatccccacaaagcggtgattcaggtcaataacggtgtgctcaatgacatcgtgacagaaatcatttccgggcgataacccggtaaggcgaggcgatgaaaaagatttttctgcaaattggcgccacccgcgacgggcaaaatccttactgcgcggtggcgaagcgcgacggctattttaccgtgctggctgaaatgggtgatttcgtcgattaccagtcgttaagcctggctctgccgtttgatctgatcattcgcctcgatcgccctgagaatccctgggaggtgatgcaggcctatctgcacgccggtttactggcgcatccgctggtggtgctggcgggctttgaagcctacaacgccagcgccggacgactgcgcgagatgctggccgggccggatgcgcccgccgcctttattccgctggataaatatgcgcagcgcatggcgctgaaaaaagcgtggccgcgcttcccgcagccggagttccgctttttcgcctcgccgctcagcattctggatgccggacaggcgctgatctatccctgcgtcgtgaagccggtggatggcggcggcggcctgggtatctggctgattgagcatgccgatcagctgcatagcgtagtgaaacagctggtgcagaccatgaactacggcggacgcggcttcagcggctttattgtggaaagcgcgctgatcggcgatgagttttcattacagggcgtggtgcatcagggacatccccaggcgctgacctgctgccagaaggtgattgagcagcaccgggatgctgagggctgcgtcagcttttatgagtcggggcatgtggcgatggcggcagcggccctgccggtctcgttcagcagcctgatgaccttctgttgcgaaacctttggctaccgtcagggtgcatttcatatcgattttattgtggtcaacggcgtgccacatttcctggagatggggttccggctctccggcatgggcgtggcgacgctggtgcaggaggcgaccggcatcaactgggcggaagtcaccttccggctggaggcgggtggcgcattgcccgcgtttgccttcaccacacccggtgcggtcggccagctgcggttgcggcaaccggcgcagctgcaggctgccgaacgctggatcgatcagcatcagcagggcgcgctgttaccgccactcagattgcctgcgttacaggtttcgtcacgctcatcgctctatgccgacctgacgcgtcacgcgggcattctggccactttcagcctgacggccacagcgcgtgagccgattatgaccacttttcagcaggtgattgccgcgcagccggtggcggccaggagagataaagtatgtgcaggatgattctggcgcatggtcggttcgacagcgcagaaattctggaggcggcgcgcgccatgagctgcggtgaaagcgccgaacacgatggcccgattaaagaacaccccaacggctggggctgtctgtggctcgaagagggtgagattcgtaccctgcacggcaccggcgcgttcgcagaagcgctgcccggtatcgatgtggatcggctgcgcagccggtttctggcggtgcatgtgcggcacgccacgctgagtaaaaatcagggactggcgttttctcatccgctgtggcgcaacagcgccggacatcagtggtacatgatgcataacggctttctgccgacgatttaccgtcagctcggtctggccgaatcgcgcttcgattcagaagagtatctgcgttatctggtagatcagaccacgcctgccgatttcacccgcgactatctgcgcgcaaagatggcgcaggtagagccgggcggcagcgcagggaatgccattttcgtcacccgtgacaaagcctgggcgtggcagtggtatccgcacgacacgccctggcccgactattttacgatgcattttcagcaacaggatggttgcacgctgatcgcctctgaacccgtggcaataccaggcagcgctggcaactggcggcgaatgaacaatcatgaactctatgaaataccgtttagggagtgataaacatggcaattttcaatcagttccgcgtgattaatcccaacatgtttgtggaatcgacctggctggatgacatcgtcaccgcacgggtgccgctgctggtgctgcgtaatttcctgacgccagaggtgcgggaagcggtggtgactgacctgcagagctgccgggaaaagatccgtgtctcccactatcccaatggcgcgctgaccacgctcggcccctatctggcgcgtcatactgcggctcccgataactactttactgagctgcgcgatatccagccggcgttgccgccctcactgaatacgctgcgcgaacagatttaccgctgggttcagcatgcgctgcggctggaaagtttacgcatcgcccacgaaccgggttgtggagactacgccggttctatcgtgcgctttcatgccaatggcgtcgcgaacccgctgcataacgacaatatcgtgcgcgacgccgcagagacttcgctggtggtgacgcaaatcctgcatcagctcagctgcgtggtctgcctgcaggagtgcaacgcgggcggagcactgcgtatctacaacaaaaagtggtcgccagaggatgagcagttcaaaaccgccggggagctgggttatcgcagtggggtgattgaaaacagcgagatctgcgaattttcaccacgcagtggcgatatctatctgtttaatcctgcgttttatcatgagatcgatcgggtcgaaggcgatacccgtatcaccatgggtttctttttcgggctgaccgataaaaaaatgaagcacgctatcgcctggagctaagccgggtcgtgccagaacaggagaagggaatgacgacgtttgaaaaaatcactgcgctgctggatcagcagcaggccagctaccgtgtggtggaacatgaggcgatagggcagaccgaacagatcagccagatacgcggtaacctgctgggtcaggcggccaaagcgatggtgctggaggtcagcatgccggacggtgcgccatcgcgtcagctgctggcgatagtgccgggcgactgccggatcaatttcaaaagtgcggcgcgcgccatcggcggcaaaaaatcctctttcgccgctccggagctggcgcaggcgttgacgggctgtgtgatgggcgcggtaccgccgtttagttttgatgaccggctggcgctgcgggtggatacccggctgcaacaggtcggaacgttatggtttaacgcgggcgagctggataagtcgatcgcgctggctgtagatgattattttcgcatcgtgggtgaaggctgctgtgccgatatcgcgaccccgattgcggtcaccgcctgacggcaggacaaggagtttctgatgtcggtaaaagatatgctgttagcgctgtgcgtggtggtggcgtggggcgtcaattttgtggtgatcaagctggggctgcagggtatgccgccttttttgctcgccgggctgcgttttaccctggtcgcctttcccgccattttctttgtgcgtcgcccgccgattccgctgcgctggctggtggtttatggcatgaccatcagttttggtcagttcgcctttctgttcctggcgatcaagctcggcatgcctgccggtctggcctcgctggtgctgcaggcgcaggcattctttaccctgttgctgggcgcgctgttgctggcggagaagctgcgctggaatcatatcctcgggattatcatcgctacgctggggatgtttttgctggcgacggctggcatggaagggcagaccagcgccggtattacgctgaccaccatgatgctgacgctgtcggcggcgctctcatggggactgggtaatatcaccaataagattattatgcggaaccgcagcgtgccgatcatgtcactggtggtctggagtgcgctggtgccgatcgttcctttctttgcctgttcgctgctgtttgatggtcaggccgccatcgtttacagcctgctgcatatcggcctgcagaccgtgctggcgctgttctatctggcgtttgtcgccaccattgtgggttacgctatctgggggaatctgctgagtcgctacgaaacctggcgcgtcgcgccgctgtcgctgctggtgccagtggtggggattattaccgccgcgctggtgctggatgagcatctctccgggcagcagatgctgggtgcggtggtgattatactgggactgctggtcaatgtgtttggtggcgtgctgggtcagcgcttagcgatgcgaacgcagtcgtaaggacaagtccgccttcagatataagggcaaaaaaaacgccgctaacgcggcgtttgtcatggttacttcagaatctcaatacggcgtggtttcgcctcttccggcaccagacgttcaagatcgatgctcagcagaccattctcgagacgggcatcgcgcaccacaatgtggtcggcgagctggaatttacgctcgaagttacgctcggcgataccctgatacaggtatttacgctcggtctgctcttcaggatgggcaccccgcacgatcagcacgttatcgtgcgccgtgatatccagttcgctctgagcaaaaccggccaccgcaatagtaatgcgatagtgattttcatcgaccagttcaacgttatagggaggatagccgccattgctctgattctgattagattcgagcaggttaaacaggcgatcaaaaccgatagcagagcgataaagtggggtgagatcaaaattacgcatattaagactcctgaatttcagcaagttttggcaaccttccactactggacaggctggatacggcaccccactgtcccttgcggcaacggtgagtgcgtccgtaaactaaaaatgggtgccacaagaccattttcaagagggcgaagtgcaatttttttcgccaatttgaggaaatgacatacactcaggactacttttgccagacccagacggacttcgccccagagtgttgacgttgtctggcaagcaaactcagccaggcttatgccatgactgaagggatgatgatgatgaaattgatgaagaccttacctctggctggagtggtgtgctgcgcaatggcaacaaccggctgttccagcgtgatgtctcacacaggtgcgagtcagggctactatccaggcacccgtgccagtgctgatatgctgtccgatggtgataccagctgggcgctgaagccgctggcgttaatcgatcttcctttctctgctgtgctggatacgctgctgctgccgtgggactactaccgcagcgacaaagataaatctctcgactctccacgtgaacgcatcctgcagagcgaaaggctggcgcatacgcaggaaagcctggcgcaggcgcagcctatgcctcctatgcggtcactgccgcaaccgtaaagagttgccgccagccattcacctcacgcatataagcaatctgtgtaccatcaggtgaccagaccaccgcgtcacctgatggcgcctcttctgttctgcgggtcagacgctgacacgcgccgctctcaacgtcacatcgcatcacgctgttatcgcagacaaaagcgatcgcctggccgtcaggatgccagctaaaggcggactgaatgctgtggctgagtcgggtgatctgacgcggttcgccgccgttgggggagaccgtccagagctggatcacctctgcggcatccgccatcagaaatgctatctggctgccatccggtgcggtgcgcagccagtggcgaggttgcagagccacaccacggctgtgcgtcaggcgacgctgctgcacgccagccggtggcgcaggtagctgctggctgctgccctccagcggcatctctccggcgcgggcgtaatcctccagcgcatcaggcagatcaacaataaaaacttcaggccgtttttcaccctgcgccgtcagcgtgtcgccaataaaggcgatcgcccagcgctgccagctgccgtccggcttctggtagccacgctcaccgacccagcactcctcacaggcacgattaatctggtcactgcctggcagcggttccgcatgcgtctggctcaccagcaggcaaaaaaaggtgccgtcatattcgcgcggatgctgcttttcaggcgttacagcgcaaaggggcaccgcgatgccgacgttgcgcagatcgagccggctatccagttcgtgcatcacgtggtcattgtaggtaaagctcaggcgagaaccgtcgggactgaagacatgtacatgcgagccgccacgcagcgcgccaggggtaaacggtggcgtgatatcgcaggcatccagattcaccgccgcaccgtttctgaacgattaccccgcgccggtggtggaagtcatactgccagctggcatcgggatgttccgggccatgaatgcagacgtagcgcggtggcagatcgggactgaccgtgacgacgccaacatgggcaccatgccgggcctgatagagcacctccacctcaccggtcatcacattgacccgctcaatggtctgactggtaaacgatgcgcccgatggacgaacgtcaaatgccagccactggctgtcggcagtccagacattaatattggtgagctgatgctgacgggcagcaaaggtgatctgtttttctgacatgatgaaacccgcggagaaagagttgcccgacaaattacgcgattctgttttgcggtgcagcatttttgccgggttaggggatccgggccgaagcggcccggcagagaacaggccgttacagcactaactcttcgatggcatgcgcgacgccatcttccatattggttttggtgatgaactgagcaattttcttaacagagtcaatggcattccccattgcgacacccgttcctgcgtattcgatcatcgccaggtcattctcctgatcgccaatcgccatcacttcttcctgcttcaggccgagcttctcagccagcattttgacgccctggcctttattcacccgacgatcgaggatttccaggtaataaggcgcgctcttcaggatggtgtaagtctgctgagcatgcccgggcaggcgggcaatcgctgcgtcgagcagagcgggccggtcgatcatcatcagtttcgggaagcgcatggcacgatccatctcctccaccgcgcggtagcgcaccggaatgccggtcaggctcgcttcatggatggtgtattcgctgatgtctttgttaggggtatagagatgggttttgtcgaatgcctggaaatgtacgccaagctcacgcgccaggttctcgatgtagaggtagtcgtcaaaggtcagcgtcacttccgccacgcactcaccatcttcggcctgatgaaccagcgcaccgttgttgctgatcgcgtactggccgggcgtctgcatatccagttccatgagatagcgctggatacccacaaatggccggccggtggtcagaacaatcgacaccccttgctgacgggcgcgatccagggcggatttcaccgccggtgtgatctcatgttgcgggttgagcagggtgccatccatgtcgatagcgatcaatttaatagccatagagtcctcgtagcgtctgggttttgttcaatgctagcgcgattcagcgcacattgaccagtttcatggcaggcgagaacggccagctgatcgccaggttcaggcggtaaagagatcgcggtggattttaatcacggcttttcggattgttgcgggttcgccaggggcgcagcaggggcgatggatatcgtgcgggaaaaagagcgcgaacatgccgggcatcagcgtaatcacagactcattcaatatcttttgataaaaaacgacgtctcgctgctgggcaaaatcttcggtgatgtgctggtcgggatgggcacgggccacgccaatattttcggtgcctgccagcagatactgaatatcgatgtagttgaagtgggactccgctttgcgtgcgctggccggttcggtcatcatctcctgcaccagacagaacattttgttgtcgggcaggatctcatatttgccggtttccagctggctgaaatctgtgctggcaatccagcttatcgcctgatcgactaccggatgaaaggcgtgacgtttctctgtcccagtcgtgacgatcgcaaacaatcatggtgtaactccctgtgtggaatagtgcgcggtaaatgcgcaaagaggggcaagagtaagggagctgaccgggttaaaacgtgatcgggatcgcatcatgcgggcaggaaggcacctccttgcgggttttccgcccggacggcacaaaaaaaaggccatcacctgggtgatggcctttcatctctgatgccggttaaatatcgatattggcggctttcagcgcattttcttcgatgaaggcgcggcgcggttcgaccgcatcgcccatcagggtagtgaacagctgatcagcgccaatcgcatctttaatggtgacgcgcagcatacgacggctgtctggatccatggtggtttcccacagctgctccgggttcatctcgcccagacctttgtagcgctggaccgagaggccgcgacgtgactctttaatcagccactcaatcgcctgttcgaagcttgccactggctgacgacgctcgccacgctcgatgtaagcatcctcttccagcagaccacgcagtttgctgcccagggcgcagattttgcgatactcaggaccctgaatgaaatcagcatccagcggatagtcagtatctacaccgtgggtacggacgcgcagtaccggctcgaacaggtttgattcgcggttttcacgcacctgtgccagataggtgctgccatgcgcttcgcgttcagtcagatagctcaccagaccattcagccaggttgtaacctctgcttcgctggtcaggtcgctcagcgtgtcgtgataaatcatcgcacgcagcatggccatcggataacggcgctccatacgcttgatcatcttctgggtgctgttgaagtcagtgaccagcgtctccagcggctcaccgcccagcgccggcgcgctggcattggtgtgcagcgtcgcgccatcaagcgcgatagcgatctggtattgatccatcgcttcatcatctttgatgtactgctcctgcttgcctttcttcactttgtagagtggcggctgggcgatataaacgtggccgcgctcaatgatttcaggcatctgacgatagaagaaggtcagcagcagggtacggatgtgcgaaccatcgacgtcggcatcggtcatgatgatgatgctgtgatagcgcagcttgtccgggttgtactcgtcgcgaccaataccgcagcccagcgcggtgatcagcgtggccacttcctgggaggcgagcatcttgtcgaaacgcgctttctcaacgttaagaatcttacctttcagcggcagaatcgcctggtttttacggttacggccctgtttggccgagccgcctgcggagtcaccctccaccaggtagatttcagacagcgccgggtcgcgctcctggcaatccgccagtttgcctggcagacccgccaggtccagcgcgcctttacggcgggtcatttcacgggcgcggcgtgccgcttcacgggcacgggcagcgtcgatgattttgccgactacaattttggcgtctgaaggattttccagcaggtattcagccagcagttcattcatctgctgctcaaccgctgttttcacctcggaggagaccagtttatctttggtctgcgaggagaatttaggatccggcactttcaccgaaaccacagcgatcagaccttcacgggcatcatcaccggtggcgctgactttggccttcttgctgtaaccctctttttccatgtaggcattcagggtacgggtcatcgctgaacggaaaccggcgaggtgtgtaccgccgtcgcgctgtgggatgttgttggtaaagcagtagatattttcctggaagccgtcgttccactgcagcgccacttccacaccaatgccatctttctcggtagagaaatagaacacggtagggtgaatcggggttttgtttttgttgaggtactcaacaaacgcccggatgccgccttcatagtggaagtgatcgcttttgccatcacgcttatcatccagacgaatcgacacgccggagttcaggaatgagagttcacgcaggcgtttcgccaggatgtcatactcaaaatcgcgcacgttggtaaaggtttcgtggctcggccagaaacgcacacgggtcccggtaatgtcggtctcacccgtcaccgccagcggtgcctgcggtacgccatggacgtaaatctgctgatgcactttgccttcgcgacgaatggtcagctccagcttctgcgacagggcgttaaccacggagacgcccacgccgtgcaggccgccggagactttataggagttatcatcgaacttaccgccagcatgcagcacggtcatgatcacttcagcggcagagatgccctcttcttcgtgaataccggtaggaatgccgcgtccatcatcctgcaccgatacggagttatcggcatggatggtgaccacaatgtcactacagtgaccagcgagcgcttcgtcgattgcgttatccacgacctcgaataccatgtgatgcagaccggtaccgtcatcggtatcgccgatatacatgcccgggcgtttgcgtaccgcatcaagtcctttcaggactttaatacttgaggagtcataagaattcgacatcaacgtttctcgctcattttaatcttcaggttgaaccgctattttaccctgttccacgcggaacatcttgcccttttcgtcggtcatgtcgattacatgtccggcagaaattgcgctgacaaacacctgagcctgagtggcttttaaccgttccgccaacaggcgtcggcggctctcatccagctcagaagcaaagtcatcaatgaggtaaatacagcggcgtccgctctggcttgtcaggaactcgccctgtgccagacgcaatgcacacatcagcagttttaactgcccgcgtgagagtaaatcttctaccggcgtcccttcagcccgaatacgaaaatccgctttatgggggccgctggcggtataggtcagtgcgcgatcgcgctcgaagttacgttccagcagttcggcgtagtcgctctctttgtcccagccacgctggaatgagaagcgcagctcaaattccggcagaaactggccacaggtggcggtgatctccgctgaaatcgccgcactgtattccgcccgccactggctgatctgttcagccagcggaaccagctcctgatcccagggacgaatctggctgtaacgtgagacctggcgcagcgccgcgttccgctgtttaagcaggcggcgcatgttgttccaggcgttaaaaaagccgggggtattatggaagcagccccagtcgacataggctctgcgatatttggggccgccattcagcaaactaaagccttcaggggtgattaactgcatcggcaacagctgcgccagctccgcgaccttgtgaccatcgctgccatcaatgcgcactttgctgtcaccggcacggtttttggtcagcccgactgaaatttcccgctctttgttttccagacgcccatgcagcacaaacgccgcctcgtcgtgacgaatcacgcgtcccgcctgcaggctgcgaaacgaacggccatgccccagggtatgaatcgcctctaaaacgctggttttaccactgccgttggcgccgaccaggaaattaaagccgggtgccagctgcagatcagcctgctcaatattacgaaaatctttgataagaaggcgggttaaagccatgaatcagtccagcgtgaagggcaataaagttttgggcctggcgatccagggcgtcaacggcaaagcaggtttgcccgatacctcagtcaccaggccgtcggcgtcgcagctacgttgcgccccgccagcgcacagccaccggagcgtactgaagtacgtgaggatggcgagcactgccggggcacaacgtagcaagtaagccaggccgatatcttctacaagcgcatgggcatgacgacataggccgctgccggactcgccacatcctcaatctgcacgctcgacaccgaatcggtcagcagcagacggacgttttcgcacttcagcgcgttcagcacatccagcacgtaactgacgttgaagccaatctccagttcagtaccgttgtagctgacatccagcatctcttccgcttcttcctgttcagggttattggcggtgatcttcaactgattttcggtgatatagaggcgaacaccgcggaacttctcgttagagaggatagcggcgcgggcaaaggcctgtttgagcagatcgcagcccgcttccagcgctttgtccggattcttcggcaatacgcgacgataatcggggaaacggccatcaaccagcttagaggtaaagatatagtcgccgacatgcgcacggatattgctgccgccaatctgaacctgcagcggggtatcgccgccatccagcagacgcagcaattcaatcacgcctttacgcggcacaatcaccgaatgactcggcagcgcctgaccaatcggcatggagcagacagccagacggtgaccgtcagtggccacggtgcgcagctcttccccttcggtttcgaacatcataccgttgaggtagtaacgcacatcctgatgcgccatcgaaaactgagtcgcttcaatcagccgtttcagcgttgcctgcggcagggtaaattcaacttcactctgccagtcgtcaagattcgggaagtcactggcgggcagggtcgacagcgaaaaacggctgcggccagagcgcaccagcatgcgatcgccttccagtgccagagtaatttctgcgccatccggcaatccgcgacagatatcgaggaatttacgcgccggaacggtggtggatccaggctcatgtgcctgagtcagcgccacgcgtgcgaccatctccatttccagatcggtaccggtcagcaacagcgaaccttcagttacctgcagcagcaggtttccgaggatcggcagcgtcggacgaccacccagggggccacttacttgttgcagcggcttcagcagctgctcacgttcaacaataaatttcatagcgtcaggaagataatgttctgatgagattagagaaatcttctttgatatcgtggctctcttcacgcagctgctcaatcttgcggcaggcatgaagcaccgtcgtatggtcgcgccccccaaaagcatcgccaatttctggcaagctatggttggttaactctttcgccatcgccatcgccatctggcgcggacgtgccaccgagcgcgaaacggcgcttggaaagcagatccgccaccttaattttgtagtactcagccacggtcttctgaatattatcgatggtgaccagcttttcctgcagcgccagcagatcgcgcagcgcttcgcgcacgaagtcgatggtaatcgcccggccagtaaagttggcattggcgatcacgcgattcagcgcgccttccagctcacgtacgttagagcgtaaccgcttggcaataaagaaggcgacttcacccggcagacggatgtcgttctcatccgcttttttcatcaggatcgccacacgcgtttccagctcaggcggctcgatcgccaccgttaaaccccagccgaaacgtgatttaagacgatcttccaccccgttgatctcttttggatagcgatccgaggtgaggatgatctgctggttgccctctaataaggcattaaaggtgtggaagaactcttcctgcgatcgctctttattagcaaagaactgaatgtcatcgatcagcagcgcatctaccgaacggtagtagcgtttgaactcttcaatcgcattgttctgcagtgctttaaccatgtcctgcacgaagcgctcggagtgcatataaaccacttttgcattgggttttcgggcaatgatgccgttgcccaccgcatgcaacaggtgcgttttaccgagaccggtgccgccatacagaaacagcgggttataagcgccgcctggattatccgccacctgacgtgccgccgcgcgcgccagctggttagatttaccctcgacgaagttatcgaagttatgacggttgttcacatttgagcgataggtcacatcggccggtgccgggacattatcccaactgggacgcataatctgcgtcggggccggacgaatatggctctgtacgggcatcacgggcgcgctgacgctggccattacaggctggctgaccgctgccgcctgctgctgaaccgggcgcgttcccacttcaaaacgcagtgcgggcacgtttggaccgcagaattcattcagcagtgcattgatactattaaggtatttgtcccgaaacccagtcgagtacgaagcgatttggagcatacaaggcaagcgtattgtcgtttaactcagcctgcagtggacggatccacatgctgaattcggtggcaggaagctcatcctgcaaacgggcaagacactgttgccaaagcgtaagtgacacggcggactccactcgtacaaattcgaaaagaatagtaggcgttactctaagaaacgttcatttttgacacagacgctaagaaagcgcctgcgaccgctatcagcggttttccgtcctgcaatcaccggaggatcgtcagcggaagggcggatcatagcgcaaagcgaggcagagatcttccctttctacacagttttgatcctttttatccacaggccagaggcgcgcaaagaagtttacgccagttgcgggaaaaaccagcagggatctggcgcaatccattaaaatttcgggcgacatctcattttatccccaggatccggcaagccgatcgcaataagatcccgtgcgatccttgcgctttagtgcggagcccgtataattctccacccgacattgagccatcaggcgcaaagtcgggactctgcgggctgtatgcgggttttcaggcactatgacacgcgaagtaaattgactcgggactgtacaattattacaatcccgcctctttattaaagacacattgaggcgtaggtcgattttctggcccgaaacgcgtcacccagtgaaaattttcaagtttaggtagaaaccgccatgaaacgcacttttcaaccgtccgtactgaagcgcaaccgttcacacggtttccgtgctcgtatggcaacaaaaaatggtcgtcaggtttctggcacgtcgtcgtgctaaaggccgttctcgtctgaccgtttctaagtaataaagcaagccctgatgggtaagctcgcatttcccagggagttacgtttgttaactcccactcatttcactttcgtcttccagcagccacaacgggctggcacgccgcaaattactattctcggccgccttaacgcgctggggcatccccgcatcggtctcaccgtcgctaaaaaacatgtgaaacgcgctcatgaacgcaaccggatcaagcgattgacccgcgaaagctttcgtctgcgtcaacatgaactgccgtcgatggacttcgtggtggtcgcgaagaagggggttgccgatctggataaccgtatgctggcggaagcgttggagaaattatggcgtcgtcactgtcgcctggcgcgcggctcctgatcgtcctgatacgcgtctatcaacgcggcatcagtccattactgggaccacactgtcggtttcacccgacctgctctcattacggaattgaggcattacgcaggttcggcctgataaaaggcagttggttgacattaaaacgcgtattaaaatgccaccccttgaacccgggtggtgacgatcctgtgccgccaaaaacctttgataccagagaacattaacgatggattcgcaacgcaatctctttctcatcgcttttctgttcgtgacctttatgatctggcaagcctggcagacggaccacgctccgcagccacagcagacgcagaccacacaaggcacaaacagcgtagcgggtgataccgccagtcagggtgtaccggccagcggtcagggccagacgatcaccgttaagactgatgtcctgtcattgaatatcaacacccgaggcggtgatgttgaacaagcacagctgctgactttcccggacaaactgggttctaaccagccgtttccagctgcttgaaacaacgccagcgttcctttatcaggcacagagtggtttgaccggtcgtaatggcccggataacccgaacaacggcgcgcgtccgctgttcaacgctgcgcaggatcacttcgagatggctgatggccagtccgaactgcgtgtgccgatgacctacaccgctgaaaatggcgtggtttacaccaaaaccttcatcttcaagcgtggcgaatatgccgttaatgtcgattatcatgtcaacaacaccacccagcagccgctggaagtgtcgctgtttggccagctgaagcagaccatcgatctgcctaagcatcgtgataccggcagcaacaactttgctctgcacaccttccgtggcgcggcctactccaccagcgagtcgaaatatgagaagtataaattcgacaccatcgcggataacgagaacctgaacgccaccaccagcaatggctgggttgcgatgctgcagcagtactttgcaacggcatgggttccgcgtaccgaaggcaccaacaccctttacaccagcaacctgggtaatggcgtggcggcgattggctataaatctgcaccggtcaccattgccgcgggcgcacagcagaatctgggtgcaacgctgtgggtcggcccggaaattcaggacaagatggcagcgattgcgccgcaccttgatctgaccgtagattacggctggttgtggtttatctctcagccgctgttcaaactgctgaaatttattcacagcttcatcggtaactggggcttctccattatcgtgatcaccttcatcgtgcgcggcatcatgtacccgctgaccaaagcgcagtacacctcgatggcgaagatgcgcatgctgcagccgaaaattcaggcgatgcgtgagcgtctgggggatgacaagcagaagcagagccaggaaatgatggcgctgtataaagcagagaaagtgaatccgctgggtggctgtctgccgctggtgattcagatgccaatcttcctggcgctttactacatgctgtcaggctcggttgaactgcgtcatgcgccatttattctgtggatccatgacctgtcagcgcaggacccgtactacatcctgccgattctgatgggcatcaccatgttcttcattcagaagatgtcaccgaccaccgtgaccgatccgatgcaacagaagatcatgacgtatatgccggtgattttcaccgtgttcttcctgtggttcccatcaggtctggtgctgtactacatcgtcagcaacctggtcaccattctccagcagcagctgatttatcgcggcctggaaaaacgtggtctgcatagccgcgacaagaagaaagcgtaagcgatccagagcgggagcaatcccgccctaaaatagtctattctcaggcggtcaaagcgaccgcctgtgttttttgtagcgagagaaaatttatgagccacagcgataccattgttgcccaggcgacgccgcccggacgcggcggcgtaggcattctgcgcgtctctggcgcccaggcggcagaggtcgcccgccagctgctgggcaaactgcctaagccgcgttacgccgattatctgccgttcaccgatagcgatggccgcgtgctggatcagggcattgcgctgtggtttcctggtcctaactcctttactggtgaagatgtgctggagctgcagggccacggcggcccggtgatcctggacctgctgctgaagcgcatcgtggcgctgcctggcgtgcgtatcgctcagccgggtgagttttcagagcgtgcgtttctgaatgacaagctcgatctggcgcaggccgaagcgattgctgacctgattgatgccagctctgagcaggcggcgcgttcggcagtgaactccctgcagggcgtcttctccacccgtatcaatcatcttgtggaagcactcactcacctgcggatctatgtcgaagccgctatcgacttcccggatgaggagatcgatttcctctctgacggcagaatcgaagcgcagctgaatacggtgatcggcgatctggatgccgtccgtgccgaagcgcgtcagggcagcctgctgcgtgaagggatgaaagtggtgattgcgggccggcctaatgcgggcaaatcgagcctgctgaatgcgctggcgggccgtgacgccgccatcgtcacggatattgcaggcaccacccgtgacgtactgcgtgagcatattcatattgatggcatgccgctgcatatcatcgacaccgctggtctgcgtgaagccagcgacgaagtggagcgcatcgggattgagcgcgcctggcaggagatcgaacaggctgaccgcgtgctgtttatggtggacggcacgacgaccgatgccaccgaagcggcggcgatctggcccgatttcgtctcccgtctgccgcccgaactgccgattaccgtggtccgcaacaaggcggatgtcaccggggagtctctcggtctgacagaagtaaatggtcactcactgattcgcctgtcggcacgcaccagcgcgggcgtggacgagctgcgcgatcacctgaagcagagcatgggcttcgccggcaatatggaaggcggcttcctggcgcgtcgccgtcatctgcaggcgctggagctggcggcaacgcacttacagcagggtaaagcgcagctgctcggtgcctgggccggtgagctactggcggaagagttacgtcttgcccagcaggcgttaagcgagatcaccggcgagttcacttctgacgatttgctgggtcgcatcttctccagcttctgtatcggtaaataaccgtgctggcctgatagcgtcctgctgtcaggccagatttcctgccacgctgctcccctgttattcccgcctctgcgttgattcttgctgatatgttattttgcggcggaacggcattgccgtataacggttgaagcgccgatctgacgtgcggcgacggattgcggtgagtgatccccgcctcatcccgccgtgccggaccggacgcaaacccactacgtgaacaccgttgggcgaactttttcgcctgaaacaggagagttgcatgagtacaccgctcgacactgccgcactggacacgctgtttaatgacgcccgcacccacagttactggcaggctaagcccgtcgataacgccctgctggagcagctctatgctttaacggcactgggcccgacctcggcgaactgctcgcctgcgcgatttgttttcgtgacctcggcggaaggcaaagagaagctgaaaccggcactctcttccggcaatctggaaaaaaccatgagcgcgccggtcacggtgattgtggcctgggaccgcgagttctatgagcagctgcccgccctgttcccgcatgctgatgcgcgcagctggtttaccggcagcccggaagcggcaaaagagaccgctttccgtaacagcagcctgcaggcgggctacctgattctggcggcgcgtttcgctgggtctggatgccggtccgatgtccgggtttgatccggccaaagtcaatgacgcctttttccccgacggtcagtatcaggttaacctgctgattaacctcggctatggtgacgcgtcaaaactgcatccgcgcctgccgcgactgaactttgagcaggcgagccgtttcgcctgatgctgcccgcgtcgcgattcgaatcgcgacgcggatgaccttataaacagcgtgtcacagcggcgcagcattttctgcaggcgtcccctgatgaaacaccattcgccagttctgaccctcgcacagccagtgtgaggcgcgcagtgcggcccgactgccatcggcatcacagctctggtagtgcagtatcagactcctctcgcccgtgctcaccagctgaaagttactactaagcatatcgggcatcgcatcttcttttatcagcgccgcgatggtctgcgcgcgagtcacaaagcgtcctgaacgggttatctcacaaaagtcaggatggagtatctgctccagccacgccagttcccgtcgcctggcactgtgcaggctgcgctctcgtttcaccatttcgtccagcaacatggctgaccctcctgttattctgtgctgacaggcagcggcaataattcctttaagctgttgaagatgggcatcgtgacgcttttgtccggttagctctcccacgcgactctgcacatcctaatccgaatttaccccaatctgtgcgttgccaggtgcattaaggtaagaaaattcctacaatgcttctgatgattatctgaccattttcacggagcgacagatggctggtcattttgtacgctggacgggcgatcccggcttcccggctaatgatttacgcattccccaggctatcaccgacacggcacagcagtttgctgacaaacgccgtgggcgatttcttgccgcccgtaccctgctggcacaactgatgctacgagtttatggcattggtgagctgccgcgcctgcttatccagagcaacggacgccccgtttttgctgacagcgatctgcccgatttcagcatcgcctatgcgggcaatacggtgggtgtgctgctggccgaagagggtggacgtgccggtctggatatggagattgtgcatgccagaagccgtcagactcaggagcagctgattcagggattaacctcgggcgagatcgcctggatcaatgcccagcaggatgccatggaggcggtgacgcagatctggacattacgccagagcattctcaagctgacgggagagggcgatcggggactggattcgctgcgcctgttgcccggtgcgggtcggctgcgatcttcactctatcccgatattcaggtggtgtgtgatgcggagcccatgctggtctggtcgtgtgcgctgtcgtctgcgactcagcgtctgcatctgtgggagatggataacgcctttcagtggcacgcattacgcgaaatagagatgggtaagcccaacatcgggcctcatgctctgcggctgaccagcctgcccagcgagcgcagcctgcatcctgaaatgtaaaaagccgcaacccggaggttgcggccctgaatgcgcttagtgcgcgtctacaaagacaatcttcagcacaaacagcagagcaacaatcactacgcaggggctgatttcacgccagcggccagtacccagcttcatgacgcagtaagcgatgaatcccagcgcaatgccttcggtgatggaaaagctgaagggcatcatggcggcggtcacaaacgccggaacggcttcggtcaaatcatcccagcgaacgcgcgacaggctggcggtcattaacaccccaacgtaaatcagcgcgcccgcagcggcgtaggacggcaccatcgcggccagcggtgacaggaaggtcaccagcaggaacagcaggccggtgaccacggccatcaggccggtacggccaccaatcgccacgcccgaggtgctttcgatataggcggtcacggatgaagtgcccgccagcgcgccactcactgaactgatgctgtcgacatagagcgcctgctgcatccgcgggaaagtgccggtttcatcagtcagtcccgctttatcggtgacgccgatcagcgtgccggaggagtcgaacagattgaccagcataaaggagaagatcacgcccgccatgccgatgttgaacgcgcctttaatatccacctggccgaccacagaagtaatggaaggcggcgcagaaaacaggccgacaaacttcacgtcacccagcatccagccgatagcggtagtaaccaccatcgagatcagcactgccgcgtggatattgcgtgatgccagaatggcgatgataaagaagcccagcgcgcccagtagtacgctgtgcgaggtcaggttccccacggccaccagagtatcgggattcggcacgataatgccggcattcttcagccccatcatggcgataaacaggccgataccggcggtaatgccgacgcgcagactcagcgggatattggcaatcatccagtagcgaacccgcagcagcgtcaggatcagcaggccgaccgcaccccagaagatcgcgcccatacccacctgccacgaatagcccatcgcgccaaccaccacaaaggcgaaaaaggcgttcagccccattgcgggcgccagcgccaccggcagattggcaaacagtcccatcagaatgctgccgaaagcggcaatcagacaggtggtcacaaacaccgcctgggtatccatgccggcgacgccgaggatctgcggattgacgaagacgatgtagaccatcgtcagaaaggtggtgatacccgcgatcacttcggtgcgcaccgtggtgccatgttcctgcagcctgaagatgcgctgcaaaacgccttgcttgctcatgccatccatccagaagaaaaaatcatcggcgcgtatcctggcgattttaccggggcaatacaatgatttttcgcaaccgattgccagtctcgcaatctgcgctgagtgcggtagagtgtggagcacacccctgaatcgaaggatagagtctgatgtcagtagaatgcgtcttttttgattgtgatggcacgctggtggacagtgagttgctctgtacccaggcctacgtcaacacctttgcccgttacggcctggaactgtcgctgcagcagatgtttgaaaagtataagggcgtcaaactctacgacattattcgtgacgtcggcgacgcgcatcaggtgacgctaccgatggaagaggtggagaccgcctatcgcgcagaggtcgcgcggctgtttgatcagcaactgaagcccatcccgggcgcgaaagcgctggttgagcagatcaaggtaccgatgtgcgtggtttcaaacgggacggtaaaaaagatgcagcactcgctgggcttaaccggcatgctgccgctgtttgcggagcacctctacagtggctatgacattctgcactggaagcctgatccggaactgatgtaccacgcggcggaacagatgcaggtacctattgagcgctgcattctggtggatgactccgaagcgggcgcccgcgccggtatcgccgccggcattccggtctactactactgcgctgacccgcacaaccctgaactggatcatccgctggtgacgcgcttcgacgatatggcgcaactgcctgcgctgtggcgcgcccgtggctgggatctggtatagcccgggccagcatgacacacaccgtctggtttttaaccctgcccggcgtgatggcgctggatctcaccggcccggccgagacgctgaagctggcgggcgagcactttatgctgcgctacatcggcccgcagccggaggtggtctgctccaccggcatgaccattggcggcatcgaaccgttaccggaacagttgcccgccgggagtctgctggtggtgcctggcgtctatgactcgcaggtctgttacgccacgccgcaggccggagaggctcgcgactggctgatgcgccagcacggcgcgctgcgcgcgcagacctttatgctggtctgcgtctgctcgggtgcgctgctggcggcgcaggcaggcatgctggatgacgtgctctgcaccacccatcatgatgtgattgcccgcctgaaagccgcagccccgcgcgcacgggtgcgggagaaccgggtgtttgtcgggcatgagaatatctggaccagcgcaggcatcacggcgggaatcgatctggcgctgcatctgattaatcagctctgtgatacgcaaaccgcgctggcggtagcgcgggagatggtggtctggttccgccgtgccggtgacgatccgcaactttcgccgtggctgcgttaccgcaaccacatgcatccggccattcaccgggcgcaggatctgatgactgcccatccggagcacggctggaccctgaccgagctggccggacgcacgcatgtcagcagccgccatctggcgcggctgtttcgccagcatctggggattagcgtgcgtgaataccatgagcagctgcgggttggcgtggcacgccagcgtcagcagcagggtgaatctgccgaaaaagcggcgctggcggcggggttttcatcggcgcgccagctacggcgcgcccgccagcgtgaagccaatcagctgacaaagtgacgggtatcgacgcgtttcaatgccatacccagcagcaggctgccgcccagcgtcagcccgaatacccagggcaggtcgagccacggacgcgacatatcatcgtaatgatgcgttcgcaggtagtgaatgaacagcgcatgaaagccgtagatcggcagtgaatagcgcgcaatcaccgttaaaccgggcagggtgcgctggttcaggctgtttttaaacacgatcagcaggctgatcgcggcgataaacaccagcggtccgcagtagagataccaggtgtcattaaacgccccgttgacgatcagcgcctgtttcgtccctaacgtaatgccaatcacacaggtgataaacagcccggcagcgagcggcgtcaggccgcgccgggtcgtttccatcgtgccgatagcccgtcccagcagcgcatagagcaggtagtagatactgtcaccgctgacatagagattaaccggcagaaagtgaaatgaccccagcgactggctgaccgtattggggttggcgagcaccgccagcaccagcaccagcagcgccacgtagcgcgcctgcacggtttttacctggatcaggggcgacagcagatagatgccgatcagcgcaaagaagaaccacaggtgataaaacaccggcttctgcagcatcttcaggattgatcgcccttcgctgatgggggtcagccaggtgatataggccagcgataccgcgctgtagaacagcagacagagcaccagccggagcatatggcgcggctgggcgctgcgtttcgccgaaaaacagatagccggagatcataaagaacagcggaacacagacgcgtgatgctgagttcagcagattagccgcatcccaggtgatgccagtcaccgccatcggcccggtgatataccaggtggtggtgtgaatcacgatcaccatcaggcaggcaaccgcgcgtaaattatcgatccagtaaatcttatgcggcatggcatcctcttgcgcatcgcgtccgtgcgcaaaagggtagccaaatgcgaccagagcaacaactgctgccagcaggattcggagccatctgtatgccagcgccctgaatcaccgcgaaaacgcgccggtagcgccagggatttacggctgcacatcgcgcggtcaaagggtatactgtcggcctctttttttaatctaaccgaagcgcgtgcacactcaacatgcaaaagtttgataccaaaacctttcaggggctgatcctgaccttgcaggattactgggcgcgtcagggctgcaccattgtccaaccgctggacatggaagtgggcgctggcacttcacacccgatgacctgcctgcgcgcactcggcccggagccgatcgccgccgcttacgtgcagccatcacgccgtcctaccgatggccgctacggtgaaaacccgaaccgcctgcaacactactaccagttccaggtgatcatcaaaccctcaccggacaacattcaggagctctatcttggctcgctgaaagagctgggtatggacccgacggtgcatgacattcgcttcgtggaagataactgggaaaacccgacgctgggtgcctggggactcggctgggaagtgtggctcaacggcatggaagtgacgcagttcacctacttccagcaggtgggcggcatggagtgtaagccggtgaccggcgagatcacctacggtctggagcgtctggcgatgtacatccagggcgtcgacagcgtttacgatctggtgtggagcgacggtccgctgggcaaaaccacctacggcgacgtgttccatcagaacgaagtggagcaatccacctataacttcgaatacgccgacgttgatttcctctttacctgcttcgagcagtatgagaaagaggcgcagcatctgctggcgctggaaaaaccgctgccactgcccgcctacgaacgcattcttaaagcggcacacagcttcaacctgctggatgcccgcaaagcgatctcggtaacagagcgtcagcgctatattctgcgcattcgtaccctgaccaaagccgtggctgaagcttactacgcctctcgcgaggcaatgggcttcccgatgtgcaataacaaaaagtaagaggcagccatgactgaacaaaccttcctggtggagatcggcaccgaagagctgccaccaaaagccctgcgcagcctggcagaagcctttgccgcgcaggtcactgctgaactggatgccgctaacctgagccacggcgaggtcagctggtttgctgcgccgcgtcgtctggcgctgaaagtcgcaaacctgagcgcctcacaacccgatcgggaagtagagaagcgcggaccggcgatctctgctgcgtttgacgctgacggcaacgcgaccaaagccgctgaaggctgggcgcgtggcaacggcattaccgtcgatcaggctgaacgtctcgccaccgataaaggcgaatggctggtttatcgcgctcaggtcaaaggcgaagcggcccaggcgctgctgcccgcaatgatcgctaccgcgctcagcaagctgccggtgccaaaactgatgcgctggggcaacagcgatgtgcagttcgttcgtccggttcacaccgtgacgatgctgctgggcgatgagctgatcccaggcaccattctgggcattaagtcagatcgggttattcgtggtcaccgctttatgggtgaaagcgaaatcacgctcgacaacgccgatcagtaccctgatgtgctggaaaaacgcggccaggtcattgccgactatcaggtccgcaaagcgatgattaaagccgatgctgaagcagcagcacgccgtttaggcggcaacgctgatatcagcgacagcctgctggaagaggtaacatcgctggtggagtggccggtggtcctgaccgcgacctttgaagagaaattcctcaaggtgcctgcggaagcgctggtctacaccatgaaaggcgatcagaagtatttcccggtgtatgacaatgacggcaacctgatgccgaacttcattttcgtcaccaacatcgaatccagcgatccgcgccagattatctccggcaacgaaaaagtggtacgtccacgcctggccgatgcggagttcttctttaataccgaccgcaaaaagcgtctggaagatcacctgccgcgtctggagacggtgctgttccagaaagagctgggcacgctgcgcgataaaaccgatcgcattcaggccctggcgggctggattgccggtgaaattggcgcagatgtgaatcacgccacccgcgcgggcctgctgtcgaagtgtgacctgatgaccaacatggtcttcgagttcaccgacacccagggcgtgatgggcatgcactacgcgcgtcacgacggcgaagccgaagatgtggcggtggcgctgaatgagcagtatcagccgcgctttgccggtgacgatctgccgtccagccctgtcgcctgtgcactggcgattgccgataaaatggatacgctggccggtattttcggcattggtcagcatccaaaaggcgacaaagacccgttcgcactgcgtcgtgcggcgctgggcgtgctgcgtatcatcgttgagaagaacctgccgctcgatctgcagactctgaccgaagaagcggtgcgcctgtatggcagcaagctgagcaacgcccgcgtggtggatgatgtgatcgactttatgctgggtcgcttccgcgcctggtatcaggaagagggtcacagcatcgacacgctgcaggcggttttctggcgcgtcgtccgacccgtccggctgactttgatgcacgcatgaaagcggtgtcgcacttccgtacgctggaggccgccgcagcactggcggcggcgaacaagcgcgtctctaacattctggcaaaatcgactgaaacgctgaatgagagcgtgcaggcgtcgctgctgaaagagaacgaagagatccagctggcgacctttgtcactgcgctgagcagcaagctgcagccttacttcgctgaaggtcgttatcaggatgcgctggtcgaactggcacagctgcgtactgcggtagacaacttcttcgataaagtgatggttaacgccgacgatcaggcggtgcgggttaatcgcctgacgctgctgtcaaaactgcgtgagctgttcctgcaggtcgcggatatctcgctgctgcagtaatgctatttgttgtgcgaaaaagggacgagcaatcgtccctttttttatgggattttttggcctgatgtcttcgactcatacctgagtgtgaccgctatagcggccattttttagggtgcaaatgaatacgctaaaatgctcaaactgccattgccggtcatcaggaatcggctgtggtgatgcgccaggttataaatattatgcttatatatcaaaattttaccttttaatttttctccggtcatactctaaggtttttcatcaatccggtggttaagaaaccgccctaaaaatagccagccctcttgtttttcccctcacctgatggataattcgccagaatttacacccggttacatttagtgaaatggaattttcatgaaaaggatttgtttatcgctctggcatccgccagtgcgtctgctcaccatggtggcaggcgcgctgctctgctctgctttcccgctgatggcagccccaccagccgataatccccgcgaagaaggccaggcaattgatgcccgcgagcaactgcgtcagcagacgcgcgagcgcgtgctgcaacagcagaatgcgccgcaggcgaatgaacatcttccccgtcctgatagtcgtctgcccggttatcctgccagtgagcagccctgctttaccatcaatcagatcgccctgactggcgatgaagccagccgttttcagtgggcgctcgacgccgccgcggatgccaccggccgctgcctgggcggacagggcatcgtgctggtcattaacaaagtgcagaatgcaattctcgccaaaggctatgtcaccacccgcgtcatggcacaggagcaggatctgaccaaaggcgtgttaacgctgacgttacagccgggccgtatcagcaggatccgttttgatgaaccggtttcctggcgtggacggctgtggaatgcgattccggcgtcatcgggcgagatattaaatctgcgggatattgagcaggggctggaaaacttcaagcgggtgcccagtgccagtgccgacattaaaatcgtgccgggcgagcaggaagccaccagcgatctgcaggtcaactggcgcgaaggcagaccggtgcggctcagtctgggactggatgacagcggctccagaagtaccgggcgctatctcggttccgccaccctcgcagtggatgcgccctttgcgcagaacgatctgttttacgccaatattggcaaaaatctgtttgagcatgggccgttcggtaaccgctcgcacaccctgaattactttttcccgataggctactgggccgtttccgccaactacaacgactacacctatcaccagaacatccccaatgccaatgaggtgctgcgctacagcggcaagagcgataatttccagctcacggtctcccggttgctctaccgcgatcagtcgaacaaaaccacgcttaatctgcgtggctaccgcaaacactccaccaacgccgtcaacgatatcgacattgtgcagcaaaagcggcgcaccgcgggctgggaactgggcctgaatcagcatagctatctgggcagcagcacgctggacgccagtatcgcctggcggcgcggtactggtgcgtttaatgcgcttcctgcaccagaagagtcgcgtcatcagggcagcgcgcgtaccggcatattgctgggcgacctcggcatcaaccatcctttcgctgtgggcgagcagccctggcgggtctacagcagtgtgcggggccaatggagtccgaatgccctgacgccacaggagcgcatggcgattgccggccgttatacggtacgcggcttcgacggtgaacagatgttgtcgggggaaaaaggactgctatggcgtaatgaaatcggctggaatcttttctctcgcgggcatgagctctatctggctgccgattatggccgggtaagcgggcctgcgactcgcgatcttgtcgggcatcagctggcaggcagtgcaataggcgtacgcggcgcgctctgggggcgcttcagctacgacctgtttgcgggcattccgctctataaacctgcgggttttcatacctcaggcgcgacggcgggtttcagcgttaacctggaaatctgaccaccaaagcgggcgatcccgctatctgaacagagtgactttcacatggatgtgacccatgaataaacattgctatcgcattatcttcagccgcacccatggggaactccgggtggtgtcagaacttgcccgcagttgcagcacggaacccggccagagccgtggcaacggcgcgccgcgtctctgggtcactttacgccgcgcggcgtggctgctgggaatggccctgtttgccgggcctgcaatggcgaacggcattgtggcggatagcaatgctacaccaggacagcggccggacgtcatcgccacccagaacgggttaccacaggttaatatcaccgcccccaatcaggcgggtatctcgcataaccagtatcagcaattcgacgtcgcgcagaaacggcgccgtcctgaataactccgcagtgatgacctcaacacaactggccggaatgattcagggcaacccgaatctcaacccagacaccccagcggcgcgggtgatcatcaacgaagtaaacagcaataatcccagccagctgcgcggttatatggaagtggcgggcggacgggcgcaggtgatcgttgccaacccggccgggattgtctgtaacggatgcggcaccatcaacgccggacggatgacgctgaccaccggcaaaccacagctcaacgctgacggcagtctggcgggttatcaggtcgaacgcggcgtggtgcggattgaaggcggcggactcaacggcgatgcacgtcatgatactgagtatgttgacgtactggcccgcgcggtggagatcaatgcgggcgtctgggccaaaaaagagctgacggtggtggccggtcgcaatcgcgtaagcgcagacgcacagacggtcacaccgctggctgacgacggcagcgccagacctgaactggcgatcgacatggggcagatgggcggcatgtacagcggccagatccgcatgataggcactgaagcgggcgtcggcgtgcgaaatgagaacgctcaggtgcaggcgggcaaaacgctggtggtgagcagcgaaggtaagcttgtctggcagtcggcggcgcaggatggcgtgacgcaggccggaggcgacatcagtcttgcggccagagaggatatcgattatcagggcaagctccacagtggcggtcagctgacggtccggagccgcgaaggcggaatcactcagtccggcaccctggcggcggcaggtgatgtgcggctgacggcggcccgcagcatccagagcagcggacacctgctggcaggcagcgatgccagtagccaggttgtgcaggaagcgaatctgcagctggagagccaggataccattcgcgccagcggcagcctgctgagcaaaaaagaggtcagcgcacgcggacgccgggtcgatctcagtggcgctcaggtcgccgccagccgcgccaccctgacggctcaggatgagggtgttgccgtgcgtcagtcggtgattaatggcacggagctggtgattaacacggcaggtgatatcgaggcgcagcaggcgcagattagcgccgggcgctggcaggtcgatggacgcagcctgttcagccagcaggccggatggtcgcagaccggaagtggcgaaagccgcttcaccctgagtggtgggctggataacagcgacggagcgattgagagccggcaactcagcttccgggccgcctcgctcaataaccagcgtggacgcatgatcgcactcgacaacgccgcccaaaaatggcggattgacggtctgctcgacaataccgcgggtgagctgggtaacaacggcgatctgacgcttgagacaggcagcctgactaaccagggtggcaccgttaaaacccaggccgcgctggctattaatgcccgcgacgcagttaacaacagtcagggcaagctgctggccggtgatgcgctgacgctcagcgcgggcggtgatcttgataatcacgctggcaccctgaacggcggtcagctgtcgctgaccgcgcagcatctgaataatgtgcagggcgagatcgtcagccagcgcgatctcgatctgacgacactacagggcctggacaacagtgatggctggatcgaggcgggtcatcatctctcactcaacagcggcggactctggcagaaccgcgacggtacagcgcagggcggtgagcgagtcacggcgacgacagatcagctcaataacgccagcggccggctgcagtctggcggtgatctggacctgaccagccgtggcgatatcctcaaccagggcggcaaactcacggcgaaaaatgccctcgcggtccatggcaccgcagcgacgctatttgataacgatggcggatcgctgcaaagcggcggcgatctgctgctgcagggcggcgcactgaacaatcgccagtcagggcagattctcagccagcaggcgctgacgctgaacctggcgggcgactgggacaatcagggtggcaccctgaccggtaatagtcgcacgcaggccagcgccgcaaatctgttgaatgctcagggcgcgatcaatgcgctggatacgctggatatgcaggttgctggtcgtctggataacagcaatggccgcatcttcagtcggttaagccagacgcttcaggcgcaggagatgagcaatgcgcagggctggatgggcagccagggacgctggactgccacgactgccggtttcgataacacggcgggcagcgtacaaagtcagcagcaggctgaactctcggcgaaactggcttagtaacgccagcggcgtgttgcaatcggctgctggcatggcgttacgcattgagcaggatatcaacaacctggccggtaaagtctctgctcagcagcagcttaccgttcagggtcagaccgaaggcagccgcaccggtaacattcacaatgcgggtggccaatggctggctggtgaggggctgactattaccgctgcgcgactcgataacacccagggcggtctgctctacagtcagcggcagttgaagctgaatctgaccggggatctggataaccaggccggtaagatgcagagcggcgaagcgttccagctggatgcgcagacgctgaacaacgcaggcggcaacatcgacagccagcaacagctgacacttcagctgtcagggcagtttgataacaagggcggcgcggtacgcagtaatggcgggcagcagatcaatgccgcagcgatcaacaaccgtcagggcgtgttcagcagccgtgaagcgattaatctgaccaccgggcagctggagaatgccagcggcacactaatcagccagggcgcgggaagttatcacgtcggcacgctcaataatcagcagggcaaagtccacagcgacgcggcgctgacccttgaagccgcacaactgaacaatcagggcggccagcttgtggccacccaggatttagtgctgaacgccacggcgatcgataacagtacccagggtgtgatcagcagtcaggcggggctctcactgcaggccgatcgccttatcaaccgcgacggcggactgttactcggcaccacctacaccgacattactgcacgtgatatcgataatagcggcggacggctgcagagcgccggaacgctcaggctgcgcggtgttgcacagctggacaaccggcagggacgggtgctggcgaatggcgatctcaccctcaacggtgatctctcaccgactgattcaccgctggtgctgctcaatcagagcggacggctggagagtgctggcgcattaaacatccatgcacactctttcaataatcagggcggcacgctgctgggcctgcaagctctgacgctgagcgcgcaacaggactacaaccgccaggcgagcgaaaccatcagcagtaacggcacggtgactgtctctctgagcggggcgtttactaacctggtggactggctgctgccgggtaatctggtgctgaatgcggcaggcataaccaacccggcgatgctggtgggcaaaacagttcagctcacgaccggtgcgctgctgaacagcgggcgtcttgaagccgacgacctgacgctgagtgtcgactcgctggataaccgtgccgcgttgatgggtgatgaagtcaccgtgcgtggtcgggtaatcgacaaccatggacagcctgcggttatcgcggcaactcaaaacctgaccctgcaggcccgcgagcggctgagcaacacagatggcgcgctgctctatagcggcaatcgcctgtcattgcagagcgatgacctgatcgagaaccgggcgagctttattgaagcggatggtgatatgacgctggaagcgcggcggctagacaacctgcgcgaagggctggtgatagagcgtgaggctgagaccagcgactacaagtggcatcgttataactactactggcgctcgtttggtacgacgataatgcccgataaaggcagtatggcaccgaccactcagcaactgactttccaggatgaggccgcggcgcagagcaatccttacggcacccttctggcgattgacgcggtgggcaaacgcgctcaggtacgggtcatgaacaatcagggcgtgctgaccgatctgtgggttaactatctggcactgaaccccggcgccgatggcacgtatgccatgacgtttctatgaaacgcgcggatttaagcagaaaaatgtgccgactccttaccagaacaccgtatggcgtgaacatgaccgtggtcgtatcgaacaatgggaccctgaacaacatatcgatatcaataacgccctctttatcagcgactacagcgctttgcgtgagcgtagcgtaaccggcaccctgacgcgtgacagactgatcaatgaaggtatcggtgcacgtattctggcgggtggcgacatgctcctgcgcatcaccggagcattacttaatgatgccagcgtgatcacggctaacggcaatctgacactggatggcggcggaagcatcgacaaccggggctattcgatcaatgagcggcggcaggaagttattgtcgatcattacgacagaagcacgcgccactggtatccgaccttcaattccgatgagaccaccgccctggcaaccgttgacggcatcattaccggcaacggcaacgtcagcattaacgggaccagcatcagcaataccaccgttaatcaggcgcagataagccagcttgaagcggcgctgcaggcagtggacgctgagcgcgctgagtatgaacgtaacccactggcctttgccgtggacggggtcgcccgccatgacggcgacacagaactgacgacgggtaataacacaacgggtcgcccactgttaccggctgaactggccctgacggcgctacaacagctggagaaagtcgccacaaccatccccaataatggtctgttcagccagcataccgcggcgggcagcccgtatctgatcgtgactgacgagcgttttaccagcaagagcaaatttatcagcagcgactatctgcttgaacgggtgggttacgatccgtcacaggtgcataaacgcctgggcgacggtttttatgagcagcgtctggtacgcgagcaggtcctgaaactgaccggcaggccttccgttaacggctgggatgcgatggcgcagtatcaggagctaatgaacaacggctctaaagtggcgcaggatttccatctggtgccgggcgtggcgttgacgccgcagcagattgcggcgctgcaacaggatatcgtctggctggtcagcgaaacggttgatacggaagacggccctcagacggtgtgggtgccgaaagtttatctggcacagaccacgctgcgcctgactggcgcgggcgcggtgattggcggcggtaatctgcagctctcggcagacagcgtgaccaataccggtaatctgtttgcggaccaggcgctctccatcgacagcgggcagtttcagcacctgggcggtgatatcaaggcgggcagcattgatgtgaaggcggagacgctgacgatcagtaccgatctgcagaatgcactgcgtcaggcgacgatgagcgctgacgatatcagcctcagcggcaccgatatccggctgcagggcgcgaaactcaatgccaccaataacctcagcctgagcgcgcgcaacaaccttgagatcggtgccgcgaaaagcagtcacagcggcagcctgaacgtgatctccggggcgatgggtaaccgcaccagcagcggcatagaagaagcgggcaggcgcatggcgcaggtcagcggcgagtggcagcaggcgcagggcagcgagcttaacgccggtggcaatcttctgctctctgccgggcgtgacctgacgctgaccggtagccaggccagcgcctccggctctgcccgggttcagtcaggcggcgacattcacatcggcgctgaaaccaccaccaataccacccatcttgaggctggcagccggacttcatcggtcagcaacagccgtcaggaagatcgcctggtgctcagcaccctgagcggtgaccagggcgtgacgctggtggcgggtaataacctgctggccgaaggcgcgcaggttgacagtaccgagggccgcattggcgtcagcgcgcagaaaacgtcaccattaaagacgcacgcgccagcctggtagctcaggacagcgaaaacaagcgcgagggtaatacccgcacccatcgtgaagaagaaagcgtgcgcgagagcagcaccggcagcaccttcagcgggcagcagggcgtgacggtgatcgggcgcgagggcgacgtcaccgttattggcagtacgctgcacagcgaacagggcgcggtcgggcttcaggcaaaacaggacgtggtgctcaacaccgccaccgaacgtgagtcactctatagtgaagaacgctcagagaataaaagcctgctgaacaaaagtagcagtcacagcgtgacgcgggacgttaccacccgtgagaacggcagcctgctgagcggcgaaagtgtcacggtcattgccgggcgcgacctgacggtgaccggctcggcggtggccgcagaccaggacgtcagtctgcgggccggacgcgacgtggagatcggcgcggcaaccgagaccgacagccactaccagctgaaagaaaagaaaaaaagcgggctgatgagcagcggcggcatcggcttcaccgtcggcaagcagtccacgcggcacgaaattgatgagaaaggcaccacccagagccagagcgtcagcaccatcggcagcagccagggcagcgtggatatcacggcgggcaaccggctgcacgtcggcggcgcagacctggtggcaggtcaggatatgaacctgacgggcgacagcgtaactatcgacccgggctttgattcacgcagccgtaaggaaaccttcgaacagaaacagagcggtctgagcatcgccctgtcaggcacggcaggcagcgcgctcaacacggcagtgagcagcgcgcagcaggcgaggaagtcgggtggcgagcgtgtcagcgcactgcagaacacccaggcggcgctgaacggggtgcaggcggcgcaggcagctcagatggacgggcttaacaccgccgccgcggacgcacacaatgccgccggcgacctgaagccggggcaggacggctatcaggcgggctcgaccaacaccatcggcgtcagcgcctcgtacggcagtcagtcgtcgaaaagcgaaacccgtaccgagagcagtcagtcgaagggcagtacgctgacggtgggccggaatctgaccgtcacggcaaccggcaaaaacggtacggcgcagagcggcgacatcagcatcgccggcagccagctgaaggcgggcggcgacctgagcctgggtgcgtcgcgggacatcctgctgcagtcggcgcagaacacgcagagcaccgatgggaaaaacagcagcaagggcggcagcgtcggcgtaggcatcggcgtgggttcaggcggctacggcatcagcgtgtcggcgagcgtcaacgcggcgaagggcagcgaaaaaggcaacggggtgacgcacagcgagaccacgctggacgcgggcaaccggctcagcctgaccagcgggcgcgacacgacgctcacgggcgcgcaggcaaacggtgagagcgtgaaggtggacgcgggccgcaacctgacgctgacctcagagcaggacagcgaccactacgactcgaagcagcagagcgccagcgcgggcggcagctttaccttcggctcaatgaccgggtcggcgaacgtgaacgtgagccgggataagatgcacagcacctggcagagcgtggccgagcagaccgggatttttgcgggcaagggcggctttgacgtcacggtgggtgagcacacgcagctgaacggggcggttattgcgagtacggcagatgccagcctgaataagctcgacaccggcacgctgggcttcggcaatattgagaaccacgcggaatatgaggtggagcatcagagtgcgggcatgagcactggcggcagcatcggcggtcagttcgccgggaacatggcgaacggcatgctggcggggctgaacgacagcggcagcgcggactccaccacgaaggcggcggtgagcgaaggcacgatagtcatccgcgacccgtcgaagcagaagcaggacgtggcagagctgagtcgcgacgtggcgaacgcgaacccggggctggacgtcatctttgataaggagaaggagcagaaccggctgaaggaggcgcagcttatcggggaaatcggggctcaggcgggagatattgcacggacgcagggcgagatcattgcgacgcgggccgcaaacgagaaaatgtctgaagccagtcaggccgaccgcgacagggcgctggccgggctgaaagcgaaggatccgacgaagcagtacagcgcagacgacgtcagtaaacaggtttacagcaacttttataatcaggcgtttgccgacagcgggttcggtaccggcggtaaggtgcagcaggccatcagcgcggtgacggcggcggtgcaggggctgtctggcgggaacgtggcgcaggcgataagcggcgcgtcggcaccgtacctggcggaaaagatacacgagctgaccacggatgcgaacggtaaggttaatgtccaggcgaacctgatggcgcacgcggtgctgggtgcggtaacctcgtacgcggcgggcaatgctgcgctggcgggcgcctcgggcgcggtgatgggcgagtacatcgcgcagcagatgtatccgggcgttaaacgtgaagacctgtctgaggagcagcggcagacgataagtgcgctggggacgctggcggcgggtcttgcgggcggcgttgtgggtgacagcacggcggatgttgttgcgggggctcaggcgggtaagaaacgcggttgagaataatgcgctgcacgccgaaggcgagaagcagcgtcaggatgcgaagtggtcgctgccgtatctggaagccgaaaagaaacagcaggctgagaagttaatcagtgacctgaatgcgaaagataaggcattcgatgcagcgttagactcagcctgtaaagggctttcttcagcagcctgccagggaatgcggcaggaactggcagcgatgtcgaagagttatgaccagcagctcgacggccagtatatcggcacgatgggcagcgtttataaagaaggaaaaggtcaggttgacgcgctgatgtggcagtatgcctcggcggatgcgaaagcggagcgcgaagccaacgttaaccgtatcgctgaaaactggggtgtgagtaaggagacagcagacggcctctataccgcgatggctggcgttcataccacagcggcgattggtggcgcggtttatgggatgaagggaagtagttcggcgcagacaggtaagaatcccgcttatatagaagagccacctttcaatccctcaggcacaggcggagctgcgcaaccgtggtcgactaaaggtcgtatcaactatgttcagctaccgaatgaaggtaaaattcgttatataccgccagaggggtactctgcatctcaacctctgccaagaggcccaaataaaggttacattgacaagtttgggaatgaatgggttaaaggcccatctcgtacagcgggccaggcatttgagtgggatgtccagttatcacgaacaggtaaagctcagttaggttgggcaacgcgagatggctctcaccttaatatctcccttgatggaaaagttacgcataagtgaaaactatgaaaatagatttttatcaagaagtagaaattaaagcggatgctaaaaatagtaagtacgcaaaatgcaagggagtcgttcttggaatcagcgaggaggagaatactgtctttggttactctgtagtaattcatgggaaagaaaacacagtgtacttcgataaagatgatgtttcccccactggtattaccttcagtcgagaagacttttattgataaaaagcccggctataatgtgctgactccataaagttggacatccaacaagtaggggttcacttcattaatagccggtttgttttatcagcccctacgcaaaatgcccgtcatcacgcttaaacttcggcgcgtcactggtgctgtgcatcgcaccaggaaactccgtcagccactgcgccaccttcttccggttgatgggcaccacgcttaagccctcgacgcagccccacagttcgcgggtggcgggcctgaaggtgcagaaagatccggaagcactggcggctgcgagggaagagctggtcaaaaaagggaagctgaacccgacggcagatgaaatagcgaagcaggcttacgacacggcgcagaaaccgttcgggaccggcggtaaggtgcagcgtgccatcagcgcagtgacggcggcagtgcagggcctgtcgggcgggaacgtggcgcaggcgataagcggcgcgtcggcaccgtacctggcggaaaagatacacgagctgacgacggacgcgaacggtaaggttaataccgaagcgaacctgatggcgcacgcggtgctgggtgcggtaacctcgtatgcgtcgggcaatgcggcgctggcgggtgcctcgggcgcggtgatgggcgagtacatcgcgcagcagctgtatccgggggttaaacgtgaagacctgtctgaggagcagcggcagacgataagtgcgctggggacgctggcggcgggacttgcgggcggcgtcgtgggtgacagcacggcggatgcggtggcgggggcgcaggcgggtaagaaacgcggttgaaaacaataatcttgcactggttgcgcgtggttgtgccgcactttcaccgtgccggaataaggttgcagagcagttgctggagattggtgcgaaagccggaatcacagggcttgccggactggccattaaagatgtagctgataaaataacctccgacgaactggagcatcttgttaccctgcaaatgatgggtaacgacgagatcaccgggaagtatctcagttcgcttcaggataaatatgctccttcgcataccggtggcaatcaacaggcgggtacagagagtttaggtaagctggaaaatcctgtgcaggacgtgaataagggaactgcgctagttacgccaaatcagacagttaagaatagtccccttataactatatctcctgaaacccagccaggaaaaaatgatggaatattcatcaatcctaaaccgacagagaatactagtactggttatatatctgagtcatctgataaaaacagtcctattagtgcaagtgattttttcaagggcacggcgtacacagataaagtcaaacaacaagctttttctggggacttccattcgttcccagaatcagtagatggtcatgctgatctgggaaaaatatcagtaattacagggggtgatggtgtggagcgtctgaagttagagatatctggcagttatcgcgggaaggaaggtgtgttcgaatatatccgtcaaccaagtggtgccataaatcatcgcctctttgtacctaaataataaatggaaatggtttgaaaaatgataaataaaatattggaattgtattcgcgttgtggaaaaagccttttagataacggacttaatgatgccgtcctaccaatgtctgtagctaatcaggctttggagttatttttagaggctaaatggacggtactgggaggggacgtttatcagtatgaagataataaaatgaagaatttttatgctgactggtactgtaatctaactgattcctctgatagctgcgattacgctaaagaacatttaagtaaattaaagggggataacatctatatctctttcacaataaaaagctgaaataatcccggccaactggccgggattattgctttaagccctgaatctcctcttaccgccgctgcagccgcaacacatctgctgctgcggcaatttcgatctgtcccgcatccgtgataccaaactcggtcagccagctgccgccgataattacctcgccgttctcccgcacccagtccgcgcccagatcctggcactgctggctggcttcgcagagttctttccagcctgcttcatcagtcacggttgtcaccgacagcgtgttatcccgcagcatcagccggatcggcgcgtcggtggtaaatccgagcgcggctagctggccgcctgtgatagtcagctccgggatgggttccggggtaaaaatgatcttcatacattctcctccgtgacgtgcacgatgcggataatcagctggccctgtttcggcgatgatgctgacgggctggcctttaataaatccccactgttccagccatcgtcctttgatggtgagtcgaggcaagggatttggtctgccgccgttggggcggtaaccaacgatgcttttgcgtgcttggggtacagcggcttctgacgtagaatcatctctagccataattaactccaatccagttagttgtggtcagcggctgttgcgggttggcgctcgcttcagccgcgctaaaaatctctcgttacgttcttccttttctgttttctcctgttcaaatatacaccgcccgctttgtaaactcgctgaaagccaggtaataaactgcgaagcgtctctgaaaaaaggattttttccggtctgtcaccattacctctgaaagcgtttaccctggcgctatgtccgtaataagtattcgggaagtaatgttaaaaatagctgattctattcaatgattacctttgagtgggttatttatcagagcttgccattagtgaaatttcagtgagtaacttatatttagcaacctgagttgtcatatcacggcgcatgatgcagtaaggttaatgggaacgataatggctgggtgtttttagcaaaaatccaataagtgatgttaattgaatgatgatcctgcagaacgattaaatattattgtatagcgtaagcgtttcagaatgttgtagaatcacacgattattaaaaggttaatataaataaaagaagattgattcaagtgatctttttgtatcaaatgaatgatctgctcaggaagcaggaagggtgaaatgaataaggatgtgaggatcaccgtatcaaagggacgattcaaaaaaatacgcgaatggaatcgaagaaaaaactactatctcaaagaggtgaaactcgaggcaagaatgtctattgcaaagcttctgtgggataaacggaaaaaagtctcctttgaacctgactccgtgaaaactatactgcttgttcgcaatgaaggaaaagtgggtgatatcatcgtttcgatgccactcatcaggtcacttcatcaggctggctatgcagtagatttgctggtaactgaagcctgttacgacgtaataaaatacagcccttttatcaggcatatttataagtcaggaaattgcagttataaccattacctgaagtctttttatcataccgtttcaaaagcaacgatgaagaagctaaatagaaataagtatgatctgattatcgatccttgcttatccgaaacgccggtgcatcgaatgaaattatttcgggatattaatgccagattcgttattggcctaaataagaaatctgacatcagccattacacagtttcggttccctataaaaatgaaaagcagcatgttacagagttactttctttgataagtaaaagcattggcgttaaagcgacaggcaatttcacttacagtcttcattttcctgatgttgtgcttgatgaggtgaggcactttcttagtccctgggaaagtaagaaaaaaattgttattaatgcttttgctggcacgccggaaaggaacttctcacaacagcaattgctggaaatcattaatatgattaataataacagcagagaggtgaaaatcatcactctggattatcgtaatgaaatagcggtgccgcttcctgaaaatgttgtgaaaaatcccttttatactttgcatcatgtgatggcattaattaaagaatcggatatggtgataacgccagatacatcaattgtacatatctctgctgcgtggaaaaaatctcttatcgccgtttacaaaaatgcgcctaataataatatgtgggcgccaggctatgaaaacgcaagccacatcattgttcatgatgataaaacatccgatgctgagaatatccctgagcgtatttttaaagaggtaatccgcaggaatttattgggcaagcgtgaggtgaaaatccagaaatctgtatcggtgatcgagttgaaagaacctgtttcgtacccacggttatcatgctcccgactgctgtatcgcctcctctgatcagctctgctgctgaccagcagataaagcgtcctgccgtgccagacaccattgtccttcttaagtgggctggcttataaagctctcacgccgcagcggcaccatatcttgcagagcagatacatacgccgactatcacgaaaggggctgacggcaaagatgtggtgaaatactgaagtgaacctgattgtgcatgcggtggtgggtatgcaggtgggtaaaaatttgcctgaaaacaataatcttttatccccaaaaaaccaggtaatagattgagaggcgcctctgaaaaacggattgttttttcggcgggttttgtgtgatttttctattcctgaatccctcttcagctcctttaaacagccagctattcaatctttaagtccaggttatgcacattataatctgtatggtttttaccctgtccgataatgacagtgcctgaaccgctgataagatgtgctatcgcgctgttgaaaaccggataccctcgacgacatctgtaagtccccaattctcaggagagagcgactcaacagagtatgaaactgacagctgccagaaaggtgagtatgattaaatcctatcaggcagaagaaagaggttacccatgagaacaacacagcagatgagtatcacgctgcccaatgaaatggcagcacaggttaaggcacgtgttgccagcggcgaatatgcatcggaaagcgaagtgatccgtgaaggattacgtgcgctgatggcacgggatcatgccgtggaacaatggctgcatgaaaaggtagtgcccgcatgggaagcgcttcaaagtggcgaaacacaaagcctgagcgctaacgacctcaggaacagactaaaagcggaacacaggaaggcaaccggggaggagtaatggtttacagggtggtgttcgcaccagaggcgcaggaacaactggcagaactttaccgttatatcgcgcaagcagcgacaccctataccgctttaaactttacggaaaacgtcatcgattattgtgagtctcttgcacagttcccacatagagggaactgtcgtgatgatcttctgccaggactgagaatcaccaattaccgcagacggacaataattgctttcatgctatctgagaaaacagtgagtgttttaggcatatggcatggcgggcaggattatgaaaatgacctgtctggagacgaaattgactgagctgtcagagcagccaggccgattatatttttcctgtgcagcgtaacaaaatgtcgcttccatgcctgcccggggcgctttgatagttatttcgcctgacccatcacgccgcaggcggcgtcgtccttgcaaagctctcgcgctgaaacagagtttctgccagtttcaccagcgcgggtcgttcgacacaccagtttcggcactacgcgacggaaattgaggtagccgatcatgcaaccagtggcgatatccgccagattgagctggccgttgttaagccatttcccctctgccgccttcgcttccagcatgtcgaggctgcgctgaatcttttcacgattgcgcagcagcacctcttccgactgtaaatttcccggacgcatctgctcgcgcacgatcaccagcgcggcatcgctgacgccatccgccagcttctccagctgacggatgttaagcgattcaagcggatcggcaggcagcagagcaggctccacgccacgcagttccagaaactccgcaatgatgctggaatcgaaccagatttgcttatcgtcagcgaccagcgccggaactttgcccagcggattgtagtgcggcacatggctgtcatcgctgtaaggcgatgcgttaacgaattcaaaagtaatgcctttttccagcatgataatcgaaatcttacgcacaaacgggctggtatagctgccaatcagtttcatcgggttctccagagtcagtgactattcgccaggaaacataaagggattgagactgctgcgtgcgaagccttcctgctccattttggcatccagtatcagcgatgccaggtcatctgccaccggttcaatggccggatctttctcctgatagagcatcttcaggtaagtgccgcagtcgccacagctctctgctttcaccgccgcccgttcgctgtcgatcgaccagtaatgcagatcacgggactgttcgcactgggtacatttgctgcgcaccacatgccattcactttcgcacagattacagtgcagatagcgcgcgccttcatgactgcccatatgcaccacgctggcgactggcatactggcgcagaccggacagaactgacgctgatcgcccatctcagcgcgtgctttgcctgggatcatggccgccatctgcgcccagtagagcgaaagcgccgcccagataaagggtgctttgtcgctgctgaccagcgcatactcgccggtaaagagcgcgctggccagcgtttccagctcggtggcggacgccttctccagattctccagcaccgccagtgcctgaccgctcatctctggtttcagctcggcaatcagtgaatgcagcagtcgctgccagtggggatcgcgcggcagggtatgaatattcagcggcggcttgccctcgctggcgctctgcgtcaggcgggcatgcaggtcgatgtgcagcggatggtcatacagcacaatctcctgcgcttcagcgatcaccgccgcaaagcgcaggtagtcgccgagtgggtttttcgccgccaggtcacgcagtcgcgcagcacgacggctgtataaatttttcagccgtggaaaaagtaacggcggaatcatctccgccgttgtcttttcgcctttctccagctgatcttgcgggattatgcgaatactcatcaggggcgtttttcctgttttattggcggattacgctgctcacgataccagcgaggatggtgctgcctggcccattcggcgctgacccagccttccaccatcgcggtcagtgtgcctttgacccacaacgcagcataaatgtgcaccataatgacgatgatcagcgccaccgctgacaccgaatgtaccaccaacgccagacgaatcagcggaatggcgaaggcatcggcaaagtaaggtcgccagatcacgatgccactggcaagcagcaacactaagctgataatagcagcccagaacacacacttctgaccaaagttatatttaccggtatcacccacctcttcattcagcgcaatccggtgaatgtttctggcccagtaaaggtcatcgcgattaatcaggttgtgtttccagtaacgcaaaaacatcagcataaaagcaacgaacatcaccacgccgacaaaaggatgcagaatacgcgccagctgtggtgtgccaaatatctgcatcagccagttgaacgacggaaagaaaaaccctaatccgcttaacgcggccatgacaaagcaaatcgcgacaatccagtgattgatgcgttcgggtgcgcggtaacgcaccagatgatcgggctttttcattatttgcgctcctcagggtgatcgtcgttgtcgtcgtgctcttcagtgacgcgattcgggccaacgccaacatagtgaaaaatagaggcggcgaacgtagcggcaaaacccaccgccgccagcggtttccagatccccttccagaaggtcaccgtcgggctgatgcccgggttagcaggcagtccgtgatagagctgaggcttgtcggcatgatgcagcacatacatcacgtgggtgccgcccacgccttccgggttgtagaggccagcctgcgcaaacccgcgcgacttcagctccgccacgcgttcctccgccagcgtcagcatgtcgcttttgctgccgaaatgaatggcgccggtcggacaggtcttcacacaggcaggctcctggccgacgctgacgcgatccacgcacagggtgcatttgtaggcgcggttatcctctttgttgagccgcggcacgttgaacgggcaacccgcaatgcagtagccgcagccgatacactgctcagactggaaatcgacgatgccgttggcgtactgaataatggcacctgccgacggacaggctttcaggcagccgggatcggcgcagtgcatgcaaccatctttgcgaatcagccaggccagcttgccgttctcttcaacttccgagaagcgcatcaccgtccaggatttggcggtcaaatcggtggggttgtcatagaccccgatgttatgaccgacttcatcgcggatgtcgttccattcggagcaggcgacctgacagcctttgcagccaatacaggtggtgacgtcaatgagcttcgcgacttcacgctggtgatcgcgcgcctgtggcggtggggtaaagccgttggtcgctgagcgacggataatatcttgtgattgataagccattgtcatctaccgttacgctttttccactttcactaaaaatcccttgtactccggggtctgcgagttggcatcgccaaccgacggcgtcagcgtattggcgaggaagcctttacgcgtggtgccttcaaagccccagtgacagggaatacccacggtatcaaccggcttgccgtcaatcatcagacgctgcagacgacgtgttaccaccgctttggctttgatatagccacggcgcgacgagactttgacgctgtctccggccttgatgcctttctcctctgccagttcggtgccgatttcaacaaactgctccggctgcgcaatcgcgttcagcagggcatgtttggtccagtgccggaacagtttcggtgatggagtaggtggtggcgacgcagggatagtcagcggcctcgcccagttgcgcggcgtcgctgctgaacagtcggacgaccggactatgacgctgctgcggattcataggattgtcggcgagcgggctttccatcggttcgtaatgttccgggaaggggccgtcggccatcttatcgagcgcaaacaggtggccaagaccatcgggctgcatgataaacggaccggcctgctgctgcggcgacagcgttaccggataatccggcacgtcaatgccgtgccagcgagtgccatcccactcaatcaggcggcgattcggatcccaggctttaccctgcgcatccgcggaggcgcggttgtagagaatgcggcggttagccggccacgcccaggcccagccggagaccgcgcccagccccgatgggtcggcgttgtcgcgtcgtgccatctggttgccttccggcgtccagctgccgctgtagatccagcaggcgctggctgtggtgccgtcgttacgcagctctgagaagccgttgagctgctggccttttttcagcaacagcttgccgctggcgtcgtaaatgtcggccagcgcctgaccgttgttctcctgcgccacctcttccggctcaggattcgacggatcgcggtagtcccagcgcattgccatcagcggttcagggtttgctccgccttccaggcgatagagcgcgcgcagacgcatgaacagattgccgaggattttaccgtcgtgcagcgcttcagcgggcggctccgcagccgcccagtgccactgcagccagcgtgacgagttggccaccgatcctgactcttcagcgaagcaggaagagggcagacggaacacttcggtctggattttcgagggatcgacatcgttgaactcgtcgtgatgctgccagaagctggcggtttcggtgcgaagcggatcgatcaccaccatatatttgaggcgggacagtgcccggaccgctttatttttgtccgggaaggcggccagcaggttgaagccctgaatcaggcaaccattgagcgcgccctgttccatcatctccgcctgcgccatgcagtcgtagctcttatcccacttcggcagccagtcgtagccccactggttttccgctgtggccttatcgccgtagaaactcttcatcaggctgacgaaaaatttgtcggtgttctgccagtagttgacctgatccggcagtgccgcaaccggcgtggcctgctgcaggtaggttgccagcgtggtcatcttctctgagggcagtggcagatagcccggcagactctgcgccagcaggccgagatcggtgtagccctgcacgttggagtggccgcgcagcgcgttaataccgccgcctggcatcccgatattacccagcagcagctgaatcatcgccgccgtgcggataatctgcgaaccgttggtgtggtgagtccagcccagcgcatagagaatagtcgcggtgcgattcggcacacaggtggaggccagctgcctgcacaccgcaataaaggattcctgcgaggtcccgcacaggcgcgtcaccatttccggggtgtaacggctggcatgggttttcagcagattcagcacgcagcgtgggtgagtgaagctctcatcgcgtttcgcatggccgttttcatccagctcatagtgccagctctgacgatcgtactgacgggtttcagcattgtaaccgctgaacaacccgtcgctgaagctgaagccttcgctgacaatcagtgcggcattggtgaaggcgcgaacatactcctgctgaatctgattgtgttgcagcagatagttgatcacccccatcaggaaaaccacatcgctgccggcacgcagtggcgcgtagagatcggcgaccgccgcagagcggttaaagcgtggatcgaccacgatgacctgcgcattgttatgagttttggcttcaatcacccatttaaagccaaccggatgcgcctcggcggggttgccgcccatgatcatcaccacattggcgtttttgatgtcgttccagttattggtcattgcaccacgaccaaagctgggggccagcgcggccacggtcgggccgtgacacaggcgcgcctgattttccagcgccagaatacccagcgagcgggcaaatttctgatcgagcaggccggtttcattactggcggcggaagagcagagcatggcggtagtcggccagcggtttaccgtgacgccagcggcattggtggcctggaaattggcatcgcgatcctgcttcatcaggcgggctatgcggtcaaatgcctcatcccagctgatgcgctgccatttatccgagcctggcgcgcggtattccgggtatttcaggcgctgttcactgtgaataaagtcgagcacgcccgcgcctttggggcagagcgatccacgactgaccggatggtcaggatcgccttcaatatggtaaatcgaggcgcgggcatttttagcgccatcacccaggctgtaaatcagcatgccgcagccgactgagcagtaggtgcagttattacgtgtctctctggcgcgaatgagtttgaactctctgacgctggctaaggctgtggtgggggcaaaaccgagtaacgccgcgctggtgcccgccaacccgccagcacagattttgaaaaaactccgtctgttaatttgcattttatcgttcttctttattggctccattgcgaagccttgcaaaatagcagccctatctgcctgtaagttgaccagggtcaacaggttagtcattagtaattctttttctaaattttgttaaaaatcctcggcaacggatccccggcgcaagcagatttcccgtagcggcagataattactgttgttttatgcttaccgatgttaaagcctgaaagatacccattctcattctgcccgccagcaggcgtggctgcgcctttcccggtgagaaaaccgcatgaattgccccgctgtttatttgcgccgcaccgggccagaaggcaaaattagtctgcgtctgatagccgttgtgcagccgcactgactgtcgcatttcattatttattaacaacaggtcgtactttttgaaagctattcagcctgactcaggcgaagatttaacaattcaggccggcgtcagcagaaacgcaggtatggcagcgtgccgatttgaccgcagcagagtctgactggctggcggacgaggtgccggtggcgctggtttacaacggcatctctcacgtggtgatgatgaccacgcccaaagatctggaggcgtttgcgctgggtttttcgctgtcagagggcattatcgacgcggcaggcgacattttcggcatggacatcgtgccgggctgtcacggcattgaggttcagattgagctttccagccgccgttttatggcgctgaaagagcagcgtcgtgcgctggcaggccgtaccggctgcggcgtatgcggtgttgaacagctggaccagattggcaagccgctctctccgttgccgtttacccagacctttgcgctggagcaactggatcgggcgctgggccagctgaaagcgtatcagccggtcggacagaaaaccggctgcacccatgctgccgcgtggatccagcccgatggtcagctggccggtggctgcgaagatgtgggtcgccatgtggcactggataagctgctgggctatcgcagccaggctgagtgggggccaggcgcggtgctggtctccagccgtgccagctatgagatggtgcagaagtccgccatgtgcggggttgagatcctgttcgcagtctcggcagcaacccgcctggcggttgaggtggctgagcgctgcaatctgacgctggtcgggttcagtaaacctggacgcgccacggtttacagccatcctcagcgactgcgttaaaccaccatcacctctggcagcgtctgctgcaacgcctcaagggcggcactgttgtcgccgccactatccgtaatcagcaggttgatcgccggtgacggcgcgtaaaccgtgcggctgactacgcccagtttagtgtgatcggccagcagatagcaggaagtggattgctgcaccatcgccctggcgatggccgcttcgtgcggatgaaaactgctggcaccacaacccgcctcaatgccgaccggtgacagcagcgccacatcggcgcgatagcggataatctcacctacagtgatttcgccacgcgtctgttgcgcacccgccgacatcatcccgcccagcaaaatgatctgattattcagcggctgatcttcttctccggcgctcagcgccagcgcggcctgcaggctgttggtcacaatcgtcaggccggaaagggcgtgcaactcctctgccagcagcgtggtggtgctgcccgcatccaggaacagcgtctgtccgggctgcagcaactgcgcagcggcgcgggcgatggcgcgcttctcccgggcctgattactgcggcgttccgttagcggcggttcagcccgcgtttcaatcgccaccagcccgccgtgaacgcggcgcgccagacccagcgcttccagctcaatgatatcgcggcgcgcggtttcgcgtgagacccccagctccctgataatgcgctcggtactcacctggttaagccgggtcagtaaggcacggatgcgatgaaggcgcgtttcctgcagcatagaggtttccttttaaagcgcgaagatcacggatgatacgccagtgaagcgaaagattccgtctgaatcagtgagcaagcttagcgcggcgatctgcctgcgtcatgtgtattttattgtatttgtgtatttggttgcattttagattcaggcaggcatgataaaggcgtcagctcttcctccttcatccttgtaacgggagtcattatggccacgcgttccaccattatggataccaacagtttccgtgccgaacatgccgatgcgctcgacagcgagacgcgcaaactgaccgataaacgcagcaaagtgcttggcgaatcttatcgcctgttctatcgcaaaccggtgcatctggtgcggggtgaagggcaatatctgtgggatgcggcgggcgataaatatctcgacgtctacaacaacgtggcgagcatcgggcactgccatccggccgtgactgaggcggtgacgcagcagatgaaaatgctgaatacccacacccgttacctgcatgaaaatattctggactacagcgaagcgctgctggcgaccacgcctgaggcgatcgatcgcgcgatgtatatgtgcaccggatcggaagctaacgacctggcgattcgcgtggcgcgcgcctttagcggcggcagcgggattattgtcagtaaagaggcctatcatggcaccagtgagctgacatccggcgcttctccggcgctgggcagtggacagccgctggcgcccaccacgcggctggtgatgccaccggatgcgtatcgtgtggacgcgcctgacctgggtgactggttcgctggccagattcagcagcagattgatgatatggcggcgcacggcattaaatttgccggcttcctggcggactcaatcttctcctcggacggcgtgttgcccgatccgcgcggcttcctgaaaaaagcggtcgaggtggtgcatgccaacggcggcatctttattgccgatgaagtgcagcctggttttggccgtaccggcgacgcgtttctggggctttggccgccacgatgtggtgcctgacatcattaccaccggcaagccaatgggcaacggcattccggtttccggcctgctggcaaaaagtgaagtgctggccgccttcagcgactcaattccctacttcaatacctttggtggtaatccggtcgcgatggcggcggcgcaggcggtactgaaagtgatcaccgaagaggggttacaggaacacagccgcgtggtcggcgcgaagctgctggcggagctgcgaaccctgatggatcgctatgagtgcgtgggggatgtgcgcggtgccggactgtttatcggttttgagctggtcaccgatcgtcacagcaaaacgccggacaaaacgctggcgctggatttaatcgagaagctgcgtgaacatcgcgtgctgacctcggtcgccggcccgtatgggaatgtgctgaaactgcgtccgccactggcgttccaggaaggggatatcgactggctggtcggcgcgctcgacagcgggctgcgcgaactgggcaggtaacgcgcagggcagggcagatgcggcgttcgggcgggatgagtgcctgctggtggtgctggctgagtgcttcgctctccctgtctgataaagctaaaaaggcggagtcagcagcagcatgctgtaaaaacaacgggttgcttttgccagatttctcaaatccttatggttaatagggcattgattacccttttacgctacatgaatttaactataatgattcgactgcttacgcggcacgtcccgaattcgtcgtgctgctcaaactaaatggagaggaagaacatgagttattcactgccatccctgccttacgcatacgacgcactggaaccgcatttcgacaagcagacgatggaaatccatcacaccaaacatcaccagacctacgtgaacaacgctaacgcggcgctggaaggcactgaatttgccaatctgccggtagaagagctgatcaccaaactggatcagctgccagcagacaaaaaaggcccactgcgtaacaacgcaggcggccacgctaaccacagcctgttctggaaaggcctgaaaaccggcaccacgctgcagggcgacctgaaagcggctatcgagaaagatttcggtagcgtggaaaaattccaggaagagttcgagaaagcggctgcgacccgtttcggctcaggctgggcgtggctggttaaaaaaggcgacaaactggctgtggtatctaccgcaaaccaggacaacccgctgatgggtgaagcggttgctggcgtttctggcttcccaatcatcggtctggacgtgtgggaacacgcctactacctgaagtatcagaacaaacgtcctgactacatcaaagcattctggaacgtggtcaactgggacgaagcagcagcccgcttcgcagctgcccagtaagttaacccagtgttaacgtgataacgataaaccggtggaatttatttcgccggtttttttatctttaaattctgttgtcccagattaaaccaaaaataaacggatctcgctttttaaccgccgcgcttttaaccttctgccacattaacacgccgttgatactcgttgtcttatgctcagtgacattcctgctcactgtgtgtcgatgactatgtcaattataactactcacgaaactacgaccgattcttctgcatcgcttttttttcagttaattagcggaaaatacgttccgaataaactctggataagtaaacgtttccggctgaaatttgtgttaagaaccttaatatcgccactgactacgctgcgttatctggatgagctgtcgcatttaccgcaactccctctgttgatgagtactcagggattgctgccagccaagctgcaccggccctatctgcgctcagggttgagcattgctgcgcgcgcgcaggcgatacttgatcattacagtctgatgaataatctggaaaaccctgcgctgcgtcagctgctgcaaagcgccacggataatccgctggctacgctgaccggtaaaaatggcgaatcctttttactttcctgcagttccggttatttcgatcgggaaggggaagtgacgctggtattacgttataacgacgaaattattgcttcactttcattttcaattctcaatgaaaataaccagcgcacattattaattggcggattacagggtccgcgaaaacatatcaataatgaggtgatccgcgaggcgaccaaagcggcgcagggtctctttccgaaacgcctgttaatggaagcggtatttattgtggcgaagcagtgcggcgtggagaatattctggcggtaggcgatgagactcatgtcttccgcagcctgcgctatcgccacagcaaaggggataagttctttgccagctacagtgaattctggctgtcgctgagtggggaggcgcgcagggatgggatgtttatcctgccgctgagcctgccgcgcaaaacgctggaggagattgccagtaagaagcgggctgaatatcgtcgccgctatgaattgctggatgcgctggcggagcaggtctatgccgccgccggcgaaacgcaaagccgatgtcgatcaggctgctgcctgatcgacccgtcagaatgcggttttggcgaagccggtcattgctgtcagccccatctcacgtcccagcgcggtcattggatgcaccacgaccaggccgcgcacgcttttcttcaacgcgcccagatttgcctgctctttcttagtaatttcgcggctgaagcccattttttgcagcttctgcgcctcggcactgagtttttcaacccgctgaccgcgcagacgctcaatctcaatgaccagcgcttctttctctttcagcaacgcgcccagtttctcgacatcacccgattccagtaactgcggctctttgcggttcaatgcgtccagcttatcgctgagaagtttgatttcgttcttttcttgctctttcatgacaacaactcgttgaggaaaacaggccaaggatacaccaaatctggcgcatattcccgctcaggttaagacgaaaaaggcgccgtgatggcgcctgacaggattagctgccggactttttaaacgcctgcttcatactgatgcgggcgatcagctcggttagcgacaggaccatggtggatcgcaccatctgcagatagcgctgctgctgcatgctgcgcagctctgcatcttcggtgtgaaacaccggtgcgggcggccaggcggtgacgcagtgcagttcaccaaacgggccaaggatctcatcgtcggtaaaacgataatcaccgctgtcgtgattcagctcttcgcgcagcgccagcagcagttcaccatcttcatattcgtgccggctgataacaccaagaccgtaaatcagcttcagacgaaccgagagttcgcccaaaggaccatcgcccagcagcagcggttctacggcatatttcaccgcgtagtcatctttgcggaagacctgcagcaccagcagattgacggcttcagccaatagctcaacggcggcgatcagaaagcttctcaccgaacgaccggcgttcaggcgctcaagcacccggttttcaaaagcctgcttctcttccattattgcctgcatgggttcaataccgccgttgggcgcaggcgaaactgcgcccggcttgcgtcactaacacgcgcgcattatgccatagcgtgccaggcgctcaccaccgaagccaccacttcgctgtcagcatccagccctgaaacctcagccagcgtcgcctgtgggcctttttctgccagcagcgtagccagctcctgcgcctgtgggtcctggtcgctgcgatagtgcatcgcggcggcaatgccctgcaccaggctggcgtgcggtaaaccatactccagcgtgcccagcgtcggcttgatcaggcgatcgcccgcgctgagtttacgcagcggctgacgacccacacgctcaacatcatctttcagataagggttctcaaaacggccaagaattttctggatgtaggccgcatgtttatccgcctcaaaaccgtagcgcttaatcagcaccgcaccgctctcttccatcgcccctttcaccacggcccggattttttcatcgaggatggcgtcacgaatggtctggtggccggccaactggccaagataggcggtaatcgcgtgaccggtgttcagggtaaagagtttacgctcaacaaatgccatcaggttatcggtcagttccatacccggaatcgcaggcaggtcgcctttaaactgagttttatcgacgatccattcgctgaaggtttcaacggtcacttccagcggatcggtgctgcccgcttcagacggtggcacgatgcgatcgacagcggaatccacaaagccgacatgctgctccagccaggcgtgatactgctccggcagcgccttcagcacatgctgtttcagctggctggtgccgcgcaccatattctcacaggcgataatatttagcgggcgggtattgccgttgtcgctgcgttttgccagccctttagccacactgccagcaatacgctccagaatctgcgggcccacggcggtggtaacgagatcgacttcagaaaccagggtgatgatctcatcgctggtgctgtttaccgcgctgacgcctttaacggtttctgttttggcctgctcgccaaccacatgaacgggatactcatgacgcgcgttcagtgcatccagcaccgtctgattcacatcagcaaaaaccagttcgatacctgcatctgccagtaacttgccgataaagccgcgaccaatgtttcctgctccgaaatgtaacgctttcataatttttgacccatatcaaatgacgatggggcgggcaaacccgccccaggaaatcgggacgggcatgaccgccccagggaaaataattgctataaattacgcgattgcaggcttacctgacagcagatccagcacttcctgcacgctggtggtgttcgccagcttctcaatcacgctgtcatcatccagcgcattggtcaggctggtgatcacctggatgtgctcgttgttacgggcagcaataccaatcaccaggcgcgccacatcgtccggctcttcaccgaacaggacgcctgccggatactgacagaacaccacgccggttttcagcacgcgatctttcgcttcgacggtaccgtgcggcacggcaatcgactcaccgagataggtcggcgtcagtttttcacgcgccagcatcgcctcaacgtattcaggctcaacgtaaccgcctttcaccagctgttcacccgcaaagcgaatcgcctgctctttgttactggcggtcaggccgaggaagacgttatccgcacccagtttaaacaggtgtgcgttgccttcatcgtagctgtcagagagcgcggtattcaccgtttgacgatgcacgtcgctgcggttagccgccaccagacgctcggtcagagtgctgtagagcgcgctgtcgaggaagttgttcagcgagatatgctgcgcatgcggagcctggcggatggcgcgttcagtcagatcacgatgggtaatcaccagatcgacatcacccggcagggcgttgatcgcggtattggtcaccgacacattgctcagcccggcgtcctgcactttcttacgcagtacgcctgcacccatcgcgctggaacccataccggcatcacaggcgacgatgattttacgcacgtgatgcagttcaacgctcatggcatcgctggcgactggggcacccgcgccgctctggcctttagactgcgctttcatctcatgcatgcgctgggtcgcggcttcgatatcgtcatcttctttgactttgctggttttcagcaggatagcggacaccacgaaggagacggcgaaggccgcagcgatagcggcgatgttcgcgaagtaggccccttttggcgtcattgccagcaccgccaggattgaacccggtgaggcaggagagaccaggccaccgttcagcaccgtcagcgtgaagacgccggtcataccgccaaggataaccgccagcagcaggcgaggagccatcagcacatacgggaagtagatctcatggatgccgccaaggaagtggatgattgccgcaccgcccgcagactgtttagcactgccacgaccaaagaacatataggccatcagcacgcccatacccggacccgggttggcttcgatcaggaagaaaatggatttgccggcttcactagcctgctggataccgagcggcgagaagataccgtggttaatggcgttgttcaggaacaggattttcgcgggttcgacgaagatcgaagtcagtggcagcaggttgttctgcaccatcagattcacgcccgcggcgagaatgtgtgacagaccttctaccagcggaccgatcgccaggaacgccagcagtgccagtatcatcccgataataccggccgagaagttgttgaccagcatctcgaagccgcttttgattttgccgtcaatcgcccggtcaaacgacttgattgcccagccgcccagcggaccggcaatcatcgcaccgaggaacatcggcatatccgcaccgacaatcacacccatggtggtaatggcaccgaccacgccgccgcgatcgccgcccaccagacgcccaccggtgaaaccgatcagcagtggcagcaggtaggtgatcatcgggccaaccagtttggccagcgtttcgttagggatccagccagttggaataaacagtgcggtgatgataccccaggcgataaacgccccgatgtttggcatcaccatattactcagaaagcgaccaaagctttgtactttgaccttcactgatgaggacataaacccaccccttattgagacgcgctgcaataggagagcgcgcttgtttttgtttagccaccccgacccaaagccggtggtattactgtatgcacgcggactctatcacgcgaatttgacgctgcgtagcgtgcggggtaagtgtgatctacatcactgattaagggtggtggcaggggtgattagcgtgattttgatcacactttaaggcgtagctcaggctcagttggctgatttttagacggggtggccggttatctgtgaggtgaatcacacttgtttgacgttgatttgttatatatctgtgacttagatcacaaactatttttggtcgaaaatgcgccagatcacacttcattcagcgggtgattgggtgggaggagaaaagagagtgggacgggcagacgattagcgcctgcccgtaaagcgggtttactgcagaccaccctggacggcagcctgtgcctgaggaagcgcctgcgaattggcggataaagtgctcatcagcgcgttatattgcgaagcctgatcctgagtcgggaactgtacgccgccatcattgaagctgacacgggttccctgcgtttgcaggaaatcgccggtctgcactgcaccctgactcagcgcctggagttttggcagcagaggaatcagctgattggcaggcaccgtcactactttgttataggcggtgtcgtagacttttttcaggtcatccggctgcttcagggtcgccttgctgctgtccgcctgcattttggcgctttcaatctgctgggtgacgatcaccagtgcgctggtcgcctgacgcagggaatcacgacggctgagataatcctgcggaacgcgaatagcagaaagctcatccaccaccggacgcataccctgttcaaccgctttgttcgcctgctgcgagaagccatacataatggcgtaatcgctggcgaagttgccaaagctctgcttctggttttcgctgaggctgggcagatgctcgccgctgcgcatcacagtgttctggagaaaatcgataaatgctttgcgctgctcgccttctttatcaccgcatgcggtgagttgcagcacgatcagcgcgccagcgagcataatgccgccacgtgccataaggcgtgtaagtcctgaagccatagggtcaactcctgtcggtgatactgtcagatgtccaggtaggaatggcctaaagaatagaacaaacccgagccacggcacaacgtgaaaccacctgtgaaacagatgctttctgaaacgccggttacagaatgggaccgcctgcgcctcagggcgtgctgcattccctgccatcgcaggcttcagcgcgcagagatgaaggaggggctaagcagtctgacgctcactgccgcgaccttaaaacaccaccgcctgaccatctttgcgactctcactggccgcaatgtagaagccctgcggatcgcgcactatcgcctgcgcgccaccaaaattgtaattactcaggggatcttccagtaccacgttgtggcccatacggcgcagtgtgctcagggtattgcgatcaagtgtggattcaaacaccacctcgcgtccctgcaccacgcgccagcgcggcgcatcaatcgcggcctgcggattctgctggtgcagcataatccgcagcgccagctggaggtgtccctgcgcctgcatcgggccacccatcacgccaaacgccatcagcggctggccctgctgatcccgcgcaaaggccggaatgatggtatgaaacggccgcttaccgcccgccacgacgttgggatggtctggatcgagtgaaaagcccgcgccccggtttctgcaggctgatgccggtatcgggtaccaccacgccggaaccaaatcccatgtagttagactgaatgaatgagaccatcatgccgctggcatcaccggcggcgacatacactgtgccgctctgctgcggtgatccaaagcggaaatctcccgccttgtcaggatcaattaacgctgcccgctggcgaatatagtcgttgctgagcaggtgttccgccggaaattcgagatgatcttcatcggtgacataacggtccagatcaaccagcgccagtttcatcgcctcgatggagagatgcagccactgcggcgaatccggtgcatagcggttgatttcccactcttccagaatgccaagtgcaattaaggtcgcaatgccctgaccattcggcggcagctcctgcaccgatcctccggcaaacggacgcgacagcagggtaacccagtcggcacgatggtttttcaaatcctccagcgtcagggctgcgccatgctcacgggcgaaggctgtcatcttttgcgccagtgcgccgcggtaaaagctttcgccctgagtctcagcgatttcctgcaaggtgcgggcctgagccggattgcggaatagctcgccagcacgaggaggacgaccctgcggcgcaaagcagtcgctaaagccaggttgatcccgcagcttgtcatagccgcgctgccacagctgaccaatcagcggtgaaaccggaaaaccatggcgcgcatagtcaattgccggttgtgccagggtggtcagcggtaaggtgccaaagcgctgtgccagtgtgacccatgccgagacggcccctggcacagtgacggattcccagccggtttcaggcatcgcactaaaatcggcaaagcgttcgggatgccacgcggctggcgatcggcctgaggcgtttaacccatgcagctcgctgccatcccagacaatggcaaacgcatcgctaccgatgccgtttccggttggctccagcacggttaaggcgatggcggtggcgatagccgcatccacggcgtttccaccctgttgcagcatccgtaaacccgcctgcgccgccagcggttgagaggttgcgacggcattacgacccatcatcggtacacgatgagaagggtatccgacgttaaaatctgtttctcgcatcgcttttccttacagaggtcaggtatgggttttgcccgtcgtcagtgcgttatcacggggctgcacttttaccgcgcatcaggtcgatagttgccgggtaactgcaccggcatgaggcgccagccgtttcgttaagacgactgttgattaatctggcgacagagcgccgttaagaataaaagatttacccgctctgcactgtgagccgccgcgcgccaggcctcaggccccaaccaggactattcttaatttaataagatcagtgaatatatgtgttcaggaagtaaaccattggcgtatattttgcaatcactacctgaagaggtgtattgcctcacagaaatgagaatatgccagcaaaaagcttgatggcatccacataaatagcaaacaccatttgatttttctgcccacaccgaaggcacaaaactcaactgcctcagcgggttagaggcgctggaacttttccggcaaaccatagttaaaaaaataattataaattgcgcggcaaatagtcaggtctctatccatacttagtctcccggcatttgttgcattgacctgacatctttaaagcagtgcaccgcaggctgtgtcccgtaatggtttctctcataacaaaaataaacccttgcgggatccagcctgaaacaggcccggtttcagagtcctgacttcaggctcgtacctctctactttcacgtgcttcatagcgagtttttaaggagttctctatggaattaaaagacccgatgtttgaattgctcagcagccttgagcagattgttttgacacgtgatgatcgcgccgccgagttacttattcagcgtcagcaacccgcccagccagagccgcagcgtctgcgtgaaatgaccggcatgcaggttgatgagtttgcaaaagtaatgggcgtgagcgtttcttccgtgaaaagctgggaagcccggcgtacccgtccttccgcgacagcgcagaaattgatgaagttattacatgccaatccctatctgggacggcagttgcttgaataaactgatatcacgaaaagaacccgccgctggcgggttttttattagcgtaattcgctgtatttagccgcctgtctggcaaaccagctctccggcacgctatagggcggctcccgcaactgtgcgagtccgctttcaataatcattgaagcctgctgccataactgcgcatctccctgcttcagcaactcaatctgtatctgcttttcaaccaggtagacccgcgcaaagtcgggatcaaaacgcacaatcgcgcgggtgttatcgatgatgtcagccagtttgatggtttgtgcctcaggactggcgctggctgtatggcggaagtgcgccagtttacgggccgtccgattttttgccccagcgggcgcgctgttggtcagcatctctaccaggcttgccacgcgcgtaccaaagtgggtttcgatatcgctctgtgtggttgcggtatcttccacggtatcgtgcagccaggccgccgctaacaacgcgtcgtcatggctgacgctgcgcaccagttccaccaccgctgccggatgaacaatataaggctcatcggtatatttgcggcgctgtccggcactggcatgtgcctcggtggcgaagcgacgcgcctgttcttccagtgaatcctgcatgcctttccccctgacaaaaagtttgcttgcaattatctagcgcgctatctatattattaaccatgaactgtgatcaagatgacaaaaaagtgaaaacgatgccactgttggtcgatcagcacctctgctttgcgctttattctgccaacctggcgatgaataaagtctatcgtcagttgctgagccagctcgacatcacctatcctcaatatctggtcatgctggtgttgtggcagaaagatgatgtcacggtgtcagagattggcgagcagctttttttagactcggcaacattaacgccacttctgaagcgactggaaagtgcaggcctgattaaccggcagcgaacccgtcaggatgaacgccaggttgcggtgacgctgaccgaagccgggcaggcgttacgggccagggctgaagccattcctgaagcggtcaagtgtgccacagcctgtgatgatgacgctttgctggcgctgaaattacagctggatgggttgcgagataacctgaataagtcacgataaatattgctgacgggtgcgcggcacccgttaaacctcaccgcctgattacagctgtataagtagtgggcgattaaatagcgtaacggagaaatgtcatgtctttagaacaagtggtttaccgcgccaaagccaaagcaaccggtggtcgtgatggtcgtgcaacctcttctgacggtgtactggacgtgaaactgggcgtgccaaaagagatgggcggtgcaggcggcgaagtgactaaccctgagcagctgtttgctgcgggctattctgcctgcttcctgggcgcgatgaagtttgtggcgggccgtgacaagatcaccatgccaaaagacgcctggatcgaaggtgaagtgggtatcggccctatccctgatggttttggtattgaagcgaccctgaacattcacctgccagagatggatgaagcagaagcgcagaagctggttgatgcggcacacatcgtttgtccttactcaaacgccacccgcaacaacatcgatgtcacgctgaacattattcgctaagcgtgctgcgggcctgaaactatcaggcccgcacttttttccctctctcattttcgctctcctgctgctgtctgcgacagcccacctggccgttcctgtccgctgtgtacaaaaaatgtgctaatcaggtcgacaacgattattttctggtctatcaaacgcgaccatgttttactgagccacctcgcgttatagcctgtaaatccgttcagaattttccttcatcttgtccggtccgcttattcagcgaactctgccgcgtttcggcagtcacataaaagatttggtcaagcgcttcacaccggagaaacaccttttttcatgaattacattaaaaccctgactcagcagaagttatcgctcttgctggcgctctatctcggtatcttattgaatttgccgattttctatcgtcgttttgacggttttctcaggcactctacggttacgaaactggctgactgccgtcaccgaggtagtggccattgtggtgctgactttcttcctgatgcgtctgctgtcgctgggaggaaagtggttttatcgcgtgctggccacgctgattgttctgatttcggttgccgccgcctattacatggcgttttttaacgtggtgattggctacggcattgtggcttcggtgatgacgactgacaccgatctctctaaagaggtgattggttaccatttcattctgtggatggtgctggtcagcgcgctgccactgctgatgatctggcgcaataagctgagcatgacgctgaacgaacagctgcgtacgccgggacagcgcctgaaacccaccctgatcatgctgctctgcgtggcgctggtctggctgccgattcggtttttcgacaagctgcagaagcataacgaagagatcactaacatcgatctgccgagttacggcggtgtggtggcgcactcttatcttccttcgaactggctggcggctgtgggcctgtttgcctggacccgtgtggatgagtcgctgaacagccaggaactgctggatccggcgaagaagtttacctacgtcgcgcctgccgggcttgatgatacctatgtggtgtttgtgattggcgaaaccacgcgctgggatcacatggggatgctgggctatgagcgtgacactacgccgaagctgtcgaaagagaagaacctggtggcattccggggcgagtcctgtgataccgcgactaagctgtcactgcgctgcatgttcgtgcgcgaaggcggcaccatggataatccgggccgcacgctgaaagagcagaatgtgtttgcggtgatgaaagagctgggcttcacctctgagctatttgcgatgcagagcgaagtctggttctacgacaacatcaatgccaacaattttgccttccgtgagcagatcggttcagagaagcgtaatcagggcaaagcggtggatgacatgctgctggtgccggagatgaaagcgtcactggatcgtttcccgaaaggtaaacatctgattgtgttgcacaccaaaggttcgcactacctctattcacagcgttatccgcgcagcttcgcgaaatatcagccggagtgtatgggcgtggatgagacctgcagcaaagcgcagttgatcaacgcttatgacaactcggtgctgtatgtcgatagcatgctggatagcgtgctggatcagctgcgtgataagaaggcgattgtcttctatgccgccgaccatggtgagtcgattagcgagaatatgcacctgcacggcacgccgcgtgagatggctccgcctgagcagttccgtgtgccgatgatggtctgggcgtcagataagtatctggaagacagtcagaaccgcagcaactttgagcgtctgcaggcgcagcagcgcgtgggccggacccatcgccacgttgagttgttcgataccatcctgggctgtctgggttacacctcgccagatggcggcattaacccggccaacaactggtgtcaggcaccgggtaatggtcaggctaaaccgctgtaatagtggtcgaaaagggtaaagcaggcggctgattcccggtaaccgcgtgctttccaggcgattggcgtcaaaagcataaaaagcggttgacgctgatcgggggtagcagtaacatgcgcccccatcggcgagtagcgcagcttggtagcgcaactggtttgggaccagtgggtcggaggttcgaatcctctctcgccgaccatatttaagaaacctgtctgaaaagacaggttttttttcgtctttagaaaagaggatgagaacctccgaaggaggtttgagccgagcgtagcgagacaacgttgcttcagcaacggcccgaagggcgctgctcgcagagcagagtaatcctctctcgccgaccatatttaagaaacctgtctgaaaagacaggtttttttcgtctgaagaaaagaggatgaaaggtacggatttaccgttgagcgggcttcagggagcatacgtctggcagacgcatcaggtacttacagaagcatctcagacaactgacagatccaaacccgagtgacgctgacagcaatcaacaatcttaaggcgaagggaacacgggcagaggaggaaagcgtcccacgccatggacggcgtgggccgagcgtccatggatggtttaagcgcctttccgatctgaccgtgttcccgaagcagtctcgatctggccgctaagcattaacattattaccgctgagtgggcttcagggagcatacgccttccgcaaagacgcaaaaacaccatccctggcaggctcaacgcaggcgattacgcacctcatccctgaggtgagcccgtagccgggccaacgctttgcgttgttcaaaaacgctcccggcgtttttatccgggcggcgcgatgctttgctacaggcgtatgctcccttcgcttcacgtctggcagacgcatcaggtacttacctgggagcctcagacggctgacagatctaaacccggatacatctgaccgcagcgcataaactcaaggcgcagggaacaggggcagaggaggaaagcgtcccacgccatggacggcgtgggccgagcgtccatggatggtttaagcgcctttccgatctgaccgtgttcccgaagcagtctcgatctgaccgctaagcattcacattcttaccactgagcgtccagggatggtttaagcgcctttccgatctgcccgtgttcccaaagcaatctcgatcttaacgccactcccgcttgccatcttcgctatcttccagaaagttccagtaaaccccatccaccgcgcattctgtttaccagccgttgttatcatcacttacccgctggcaggccttgccatataagagatgcgatcataattcgcgacacattcttcttatgaccgaaagcggcaacatgctgatttcttatgcttctttaccagcatattccgctggatgaacgtcataacgcacggtgaatcgttcagttattcaacatttgccggtaaaagttttaagttttttagcggtgagaatcactagcgatagaacagccatccagcacaatgcacggaaatcagaccagcagcgctgtgcattgtatggcttttaggccgaaagggtttttattaccgttgcatgctatccctcacactctgtgtaaataagtaaccgttgtattgacgttctttgcaactgttgacaaattgatgcgtcaataaacgcacagttacggaattttctgaatgcaccatctgcataagaaaaaacaaaaaaaacgtagcgtgctttaaccacctgttcggtggtacgcctgaaccgcataaaaaaatcagaggtcgggcaatacacacaacatcacatcacaatggagcaaaagcatgatcaactccctggctaaatccgggatgctgaaggtcggtctgagcctgattgctatgactgtcgccgccggtgttcaggcaaaaaccctggtctactgttctgaaggttctccggaaggctttaacccgcagttgttcacctcgggcaccacctacgatgccagctcacgtcagatctacaaccgactggttgagttcactatcggcaccaccgaaactgcacgctgcgctggcagagaagtgggatgtcagtgaagacggtaaaacttacaccttccacctgcgcaaaggcgtgaagtggcagaccaccaaagatttcaaaccgacgcgcgacttcaatgcggatgatgtggtgttcacctttgagcgccagctggataaaaacaacgcctatcacggcgtctccggcggcagctacgaatatttcgaaggcatggacatgccgaagctgatcagcaaaattgaaaaagtggacgagaacaccgtgcgctttgtgctgacgcgtcctgaatcgccgttccttgcagacctcggcatggacttcgcctcgattctgtcgaaagagtacgctgacaacatgctgaaagcgggcaccccgcaaaacgtcgacctgaacccggtcggtaccggtccgttccagctgctgcagtaccagaaagattcgcgcatcctttacaaagctaacccgaattactggggcaccaagccgagaatcgatcgcttagtcttctctattaccccggatgcttcagtgcgttacgccaagctgcagaagggcgaatgtcaggtcatgccctatccaaacccggctgacatcgcgcgtatgaagcaggacaaaaacatcaacctgtatgagcaggctggcctgaacgtcggctatctgtcgtacaacgttgagaaaaaaccgctggataacctgaaagtgcgtcaggcactgaccatggcggtcaacaaaaaggcgattatcgaagccgtttatcagggtgcaggtcagcctgctaaaaacctgatcccaccaacgatgtggggctataacgacgacgtgaaagattacgcctacgatcctgagaaagccaaagcgctgctgaaagaagcgggcatggcagacggcttctcaatcgacctgtgggcaatgccggttcagcgtccgtacaacccgaatgcgcgccgcatggctgagatgatccagagcgactgggcgaagattggcgtcaaagccaaaatcgtcacctacgagtggggcgaatatctgaagcgcgccaaagcaggtgagcaccagaccgtcatgatgggctggaccggtgacaatggggatccggataacttcctggccaccctgttcagctgttcagcggcaaaagatggctctaactactcgcgctggtgtgataaatcctttgaggatcagattcagccagctcgcgccaccgccgatcaggcgaagcgcatcgagtactacaagcaggcacaggttgtgatgcatgaccaggtaccggcgctgatgatcgcgcactcaacggtatacgaaccggtcagcaagaaagtctccgggtacaaagtcgatccgctgggcggacactactttgctcaggtagacattaaagaataattgtcgccttttccggggtggctgcgcgtcgccccggctttatctccctgttttactggaaacggtagaggcgcagcctgtctgcgtcgcggtcgggcctacccgatcgtcagatgtaagcaataactaccctcgcggcgacggtcgcgcggacaagagagaaacccggattatgctgcagttcatactccgacgtctgggccttgtcatcccaacgtttatcggtattacattactcaccttcgcatttgttcacatgatccccggcgatccggtactgatcatggcgggcgaacgcggtatttctcctgaacgccatgcacagttaatggcgctgttaggtctggatcagccgctgtggaaacagtacctgaactacattaacggcgtattacatggcgacctgggcatttcactcaagagccgcatcccggtctgggatgagtttgttccgcgcttcaaagcgacgctggaactcggcttctgcgccatgatatttgccgtggccattggtatcccggttggggtcatggccgccgtgaagcgggggtcgattttcgatcacaccgccgtggggatctcactgaccggctactccatgccgatcttctggtggggcatcatgctgatcatgctggtctcggtacagctcaacctgacgccggtttccgggcgggtcggcgacaccgtcttcctggatgacaccatgccgctgaccggctttatgctgatcgataccttcttctggggtgagccgggcgacttccacgatgcggtgatgcacatgattctgcctgccatcgtgctcggcaccattccgctggcggtgattgtgcgaatgacgcgatcggcgatgctcgaagtgctgggtgaagattacatccgtactgcgcgtgccaaaggcctgacgcggatgcgcgtgatcgtagtgcatgcgctgcgaaacgccatgctgccggtggtgacggtgatcggcctgcaggtcggcaccttgctggccggggcgattctgaccgaaaccatcttctcgtggccgggcctgggtcgctggctgattgaagcgttgcagcgccgtgactatccggtggtgcagggcggggtgctgctgacagcagtactgattattgtggtcaacctgctggttgacctgctgtatggcgtggttaacccgcgcatacgtcataagaaataagggggcatcatgtctgttgttgatcccggcagcgttaccgttgcacccaagccgatgaccccgtttcaggaattctggcactactttaaacgtaacaagggcgccgttgtgggcctggtctacatcatcattgtgttgctgtgtgccatttttgccgatgtgctggccccgcatgcccctgctgaacagttccgcgatgcgctgctgcatccgccggtctggcaggaaggcggcagctggagctacattctgggcaccgacgatgtaggccgcgatgtgctgtcgcgtctgatgtacggcgcgcgcctgtcgctgctggtgggctgcctggtggtggtgctgtcactgatttttggcgtgatatttggcctgctggccggttatctcggcggcgtggtcgatgccatcatcatgcgtgtcgtcgatatcatgctggcgctgcccagcctgctgctggcgctggtgctggtcgccatctttggcccttcgatcgttaacgcctctatcgcgctgacctttgtggcgctgccgcactatatccgtctgacccgcgcggcggtgctggtggaagtgaaccgcgactatgtgaccgcctccggcgtggccggcgccggtatgctgcgccagatgtttgtgaatattctgcctaactgccttgcaccgctgatcgtgcaggcttcattaggtttctccaacgccattctcgatatggcggcgctgggctttctcggtatgggtgcgcaaccgccaacgccggagtggggcacgatgctctccgacgtcctgcagtatgcgcaaagtgcctggtgggtagtgaccttccctggattggtcattctgcttaccgtgctggcatttaacctgatgggcgatggtttgcgtgatgcactcgacccgaaactcaagcagtaaagaggcaccgagatggcgttattaaatgtagacaaactatcggtgcatttcggcgacgataaagcaccgttccgcgcggttgaccgcatcagttatcaggttgagcagggccaggtcgtgggtatcgtgggcgagtccggctccggtaaatcggtgagttccctggcgatcatggggctaatcgatttccccggcaaggtgatggctgagaagctggagtttaaccagcgcgacctgcagaacatctccgaacgtgagcgccgccagctggtgggcgccgaagtggcgatgatttttcaggacccgatgaccagcctgaatccctgctacaccgtaggtttccagatcatggaagcgatcaaggtgcatcagggcggcaataaacgcacccggcgtcagcgggcgatcgacctgctgaatcaggtcggtattcccgaccctgcgtcacggctcgatgtctatccgcaccagctgtcgggcggcatgagccagcgtgtgatgattgccatggcgatcgcctgtcggcctaagctgttaatcgccgatgagccgaccacggcgctcgacgtgaccattcaggcgcagatcatcgaactgctgctggagttgcagcggcaggagaacatggcgctgatcctgattactcacgatctggcgttagtggcagaagcggcgcaccacattatcgtgatgtatgccggtcaggtggtggagagcgggaaagcgaccgatatctttaaggcgccgcgccatccttatacgcaggcgctgctgcgtgcgctgccggagtttgcggccgataaagcacgcctggcctcgctgcctggcgtggtaccgggcaagtatgaccgcccgattggctgtctgcttaatccacgctgcccctatgcgactgacctttgtcgtcaggaagaacctgaactgcgcaccatcccaggacgccagtccaagtgtcactatccgctggacgatgccgggagaccaacttatgagtcatgaaaccacgaaagatcagttcctgctgcaggcgattgatctgaagaagcactacccggtgaagaaggggctgtttggtcaggagcgtctggtcaaagcgctggatggcgtctcttttaatctggaaacgcggcaaaacgctggcggtggtaggcgagtcaggctgtggtaaatccacgctgggccgcctgctgacgatgattgaaaccccgaccgaagggcagctttactggcacggtcaggatctgctgaaacatgatccccaggcgcagaagctgcgtcgccagaaaatccagatcgtgttccagaacccgtacggctcactcaatccacgcaaaaaagtaagccagattctggaagagccgctggtgattaatacccagctgacccgcgcggaacgccgcgagaagacgctggagatgatggcaaaagtcggcctgaaaaccgagcactacgaccgctacccgcacatgttctcaggcgggcagcgtcagcgtatcgccatcgcgcgtgggctgatgctcgatccggacgtcctgattgccgatgagccggtttcggcgctcgacgtgtcggtgcgtgcccaggtgcttaacctgatgatggatctgcagcaggatatggggctttcttatgtctttatctcgcacgatttgtcggtggtggaacacattgccgatgaggtgatggtgatgtatctcggccggtgcgtagagaagggcagtaaagaggcgatttttgccaacccgcggcatccttatacccaggctttgctgtcggcgacgccgcggcttaatccagacgaccgtcgtgagcgcattaagctgaccggcgagctgccgagcccgctcaatccaccgccgggctgcgcctttaatgcgcgctgccaccgacgttttggcacctgcgtgcagctgcagccgaagctgaaaaactatggcggacaggagattgcctgcttcgcggttgatcaggatgagaatcaaccggtcggcgtggcagaaaaggtcaactgaggattggcagcgcattctggtgtttacagaccgcacaaaattgaaagcgatgggagcataggcctgtagcaaaacattgcgctccccggacaaaaacgccgggagcgtttttgaacaacgcaacgcgttggcccggctacgggcgcccctcagggatgaggtgcgtaatcgcccgcgctgagcctgccagggatggcgtcttttgcgtctttgcgtaaggcgtatgcccccctgagcctgttcgcgatcttaactccccagccgaaggctcttttctggagcctttttttatctcaactcagctgcaagccgcactgctggcaggtcagcgagcactttctggttattcctcctctttttccgttatcagtcttaacctgttttccttctggcgatatttgcagtgaaaaaagataaatagcctcaatcacttatggcagaaatgcgattgttttgcgcctgcggcagcctgaacgctctttgaaacgctgtttacaggagtcagcctggtagtgccagaggttgtaagagcggtattttctgaaaaattattaaaacagtgctaatgaatttaacttaagtattacttattaattatcagcggtaatgactcagcaaaggctttcttccgccactattgaatctttatgattaaacaatttgattgaaattgctttttttgtaatcaggtttttctgactgatattaaagggatgtgttatattccaggaaaattcccaccttgttgcaggccatggccaatgaagaataattacgatgatttgcagcgttttaaagagaaaacgcaaacgctcgacatcgactttaaagatatgtctggccagacgcaggaagcggcggaacacagtaaatgggcattgattcgccagctggcgaaagaagaacatcagacaccgtttggcggcggcgagcgtattgacctgccgcaacctcagccgctgcgtggtgatgagtttacggctccaccgcctggggcaccggcacgacatgccgcactcactgcgcaaccggcaatggcagctcgcacctcgattctcgatagcctgtcaggcagcaacctgccagcaaccagcacgactgcacgcggcccttcatcactctttccgccaccgccaccactgcaaaaagcggccgtggctgagcctgcgaccccgctgcgtgctgagccggtccggcctgccgccgtggcggaacttcagcccgtcgtcgcacccaccgccacccattctgagccaggacgatttggtgcgctgttccgctcgcgcgagattaatctgccgaaagaaaccttactcaaaccgttactggagaagattgcgctatgccattagtttgtgtgtgctcgccgaaggggggtgtggggaaaaccacgctggcggcgaatctggcctggagtctggcgcgtttccggtagcaaagttctggcgattgattttgatgtgcagaatgcactgcgtcttcactttggcgtgccgcttcatgatggccgcggatttgtggcgcgctcagaagagcaggcggactggagccagtcgattcttaccactggcggcaatatctttgtgctgccctatggcgacgtcacggagccgcagcgcgaacggttcgaagagaacctgatgaaagatccccactttattaagcgcggtctggatactgtgctcaattatcctggtctggtgatcgtggctgatttcccgccgggcccgggccccgcccttaaagcaatgacgacgctggccgatatgcatttagtggtgatgttagccgataccgcatcagtatcgttattaccgcagattgaagagaaccggatgatcggtaagccgctcaataacaagcagggtcactattttatccttaaccagtgtgacaaccgccggaatatcaatcgcgatgtcaccgcgtttatgcagcagcgcctgggcgataatttactgggcgtggttcaccgtgatgaaagtgtgggtgaagccaatgcttcgcagcagtctgtttacgatttcagtcccgcctccgcagcggcatttgatattgaactgatcgcgaaaagggtcagcagcattctgaatatcaccgtgggtaatggcgaagttcaggctcccatccgcacaaaccacttttagtcggcttccgccaggcgactgacttacacagctcttctcagggtgaatcatgagtaaaatcgggttttacctgctgctgctggtgcttgcacccgttgcggcggtgatcatcattacgccaatggacagccagaaacagtatatttttggtctgatcagcatcggcatgatgtttttattgggtttcagcaagagccgcaaaataacggtggtgatggtggttctctctgcgctgatgtccagccgctatatctggtggcggaccaccgagacgctgcactttaattccgaagttgaagctatcttaggcattggcttatatctggcggagctgtacgtctggctgatcttaattcttggcttcctgcaaaccacctggccattaaaacgcaccatcgaacccttaccggacgacaccagcctgtggccgacggtcgatatttatgtgccttcctataatgaaagtcttgatgtggtgcgcgacaccgtactcgcggcgcagtgtatcgactacccgcgtgacaaaatcagggtctatctgctggatgatggcaagcgcagcgagtttgcccgctttgcggcggatgtcggcgtgggttatatcacccgtgacgacaataaacatgccaaagccgggaacctcaaccatgcgatgaaaatcaccaaaggtgagctgatttgcatcttcgactgcgaccacgtggcgacgcgcaccttcctgcaggcgacggtcggaccgttcctgaaagatccgaagctggcgctgctacagacgccgcactacttctattctcccgatccctttgagcgtaacctgcgcgcagcacgcagcattccaaacgaaggctcgctgttttatggcccggtgcagcagggtaatgataactggaatgccactttcttctgtggctcctgtgcggtgatccgtcgttcagcgctggaagagattggcggttttgccgttgaaaccgtgaccgaagatgcacacaccgccctgaaaatgcagcgactgggctggggctcagcctttttgtcgatcccgctggctgccggtctggcaacagaaacgtctgggcctgcatatcattcagcgtacccgctgggcgcgtggcatgacacagattttccgcgtcgataacccgctgtttggccgtggcctgaagtggcagcagcgtctttgctatctcaacgccatgctgcatttccagtttggcctgccccgcgttgccttcctgaccgcaccgctggcttacctgctgtttaacctgaatattattcactcatcggcctcgctgatctttgcctatgtgctgccccatctggtgatgtcgctctacgttaactcacgaatgaatggccgtttccgttacaccttctggggtgaaatttatgagacggtgatgtgcttccatctggtgatcccgaccattctgaccctgttgtcgccaaaacatggcaagtttaacgtgaccgataaaggcggcgtgctggatcagggcttcttcgatttccacatcgtgcgtccgcatgtgattgtggcgctgctgctgggcattggcattgtagccggcgtggtgcgcgccgtgatgcatgactattttggcgtcgatccttacgttatcgcgctcaacgtcggctgggcgatcttcagcctgatcattctgatggcggcaattgccgtggcgcgcgaaaccaagcaggtgcgtaaaaccatccgtgttgaagtgcaaatcccggcgattattcattacgccagcggcatttcatcgcgcacccagaccagcaacctttcgatgggcggcgcgcagcttgatgcacccgatggacgtcatgaaactgatgagattgaagagattgatctgctgctgaaatccggcgcgatcactatcccggtcagtcagatttccggcgatgatgagagcatccgtctgcgctttgaggcgatgccgctggcgcgtcgtcgcgagctggtccgtgtggtgctggctcgtgctgatgcctggattcagccggagtataagcaggacaacccgctgatttcgctaggcactattatccgtaccgtctttgagctgttctggctgacctggaaaggccgccacgataaacgtaaaaatgtcgacccggttgccgcggcggcgaaagaggatggggcggcatgaagatcctgacgcaaactctgctggccagttcactgaccgcagcgttatggctgacgcccgctggcgcggaaacgccggttactgctgataacagcagtgctgcgccggtaaacagttcagctccgacgccgtctgatgctgcttccaccacgcagcctgccagtgcgccggtaaacagtccggctccgacgccgcctgatgctgcttccagcacgcagcctgccgatgccaccgtcattgcacccgcgacaaatcaggctccggccagcgatgcggcatctgtggtgcccatgaataatggttccacccagacggcaggttcagaccaggtagcggtcccggtcagcggtggagagtctgcaatgccgtcagtgtcaccagcggcaaatgcgccatctgcgacaccgtccgcagaatctgcaccggcatcggcgccacagagtgcatcacccaatgccatggcacccccggtgaacgcctcttacgccccaggtagcgaggcgacatcacaaactcagccatcttcagtgaccggtgacgcgacctcaacgcctcagaccgcgtcatcgaccggtgaggcggcggcttctgcccagaccaccgcgccgatggccgccaccggcgcggtgacccaagacagcagcgcgctgtccgcggtgcccctgccgcagggcctgagcagtgccgatcccgcgctggaagcggccgccagtgcgctgccctacgcgccaggtcaggtagctgcaccggttgcagaagcgcagccgccgatcgcggctgccatcaatcagccaatcagtagtgttatttcagtggcccagatgggccagtcgcgcggcatcacgctgaccggcggccagcttcagtcgggcatcacctttaccctgcccggcgatgaagtcatcaccaatgcgcgacttaatctgacgctgcgcgtctcagctgcgctggcggcacgcaatacgtcgctgcaactgatgctgaatggtcagccgctcggcacgctgccgctgggtgcgacggacagcgatgtcagcgactatgagctggatattccggcggcgatggtggtgtcggcgaacaatctgagttttaaaatcaatgatgcggacaagttgctgtgtgaaagagagagcgcacagcagtatcaggtcaccattctgccgaacacatcgctgcaccttgagggtcagaagctcaatatcggcaccagcctgcgtaatttcccgcgccccttcctggatcctcagcggatgacggcgtccaccgtgacggtgggctttgccagtcatgtttcagccgatgctgtcagcgcggcggcactggtgacatcctggctcggcattcagagtgattatcgcggcatccgtttcccggtggtgcgcggcgaactgccggaacacaacggcatcctgtttggtcatcctggtgaccggatcggcaccctgactttcccggccagtaacggtccgatgttgcaggtggtggataatcccaataatccggtttacaaattgctgctggtcagtggcaacaatgaggagcagttgcgtcaggcggcgaaccgtctgacgacgcagccactgacgacggatgagagtcatctgcaggtccccgcacagactattgcaaaccgcaaaccttacgatgccccgcgctggattaacactgaccgtccggtacgactgagcgaactgctgcgtaaagatcagagtctgaccagtagcggcatctggcatgatgcgctgcgtgttaacttccgcgccgcgcctgatttgttcctgtgggatggcgacacagtgccggtcaatctgcactatcgcttcccgtccgaaagctggatcgatgaggataattccttccttaacgtcatgctcaacggtacttttctgcgcaatctgacggtgaacaaagtcggcctgctggagaacgcctggcaccgtctgggcggtgatgcgcgtcaggagcagtatcagcttaatctcgaaccctacctgatctatggcgataaccagctggcgctctacttcaatatcaaaccgcgggctgatgcgccctgcggtgtgttactgaacaacaacatcaagagccggattgaagaggattcatggatcgatctgagccatacccgtcacttcagcatgctgccgaacctctcttactttgtgggtgcctctttcccgttctcacgtctggccgatttcagccagaccacgctgctgctgccggaaacgcccagcgatgctgaactgtcaacgctgctggatctggcggcgcgggctggtaaagccaccggtctggcgctgacacagaatcaggtactgtttggcctgccgactggcggaacccatctggcgcgcatacagcagagcgatctgctggcggtgagcaccaccggcaacagcgcctttaaccaggcgatgctggcggcttccccttatgacgcgactggcagcacctttggggtgaaagagcccgatacgctggaaaaattacgcggctggctgaccggtgactggagtcgtcagcagctggatgccgatcgttatttctcctccaacgaagcgtggcgaggcttcctcagctatcgatcgccatggaaccgcgatcggctggtggtgatgacggtggcaaccagcgacgatcagctgttgcgactgcataacgatttgagttcagcgcagattaacgccggcattcgtggcgataccgcgattattaccgatgaaaacggcattcgcagtttccgcgtcggcgcgcagtttccccagcggtgagttgccctggtacatgatggtggtgtggtatgccaaccagcactcggtgctgctggcggtggcggcgatgctgctctccgcgctggtgggcagtgcggcctgggtgatgctgaagcgtcacgcctggcgacgtctgaaccctaagcaggaccgtgattccggcaggaagtaaggataataataatgaaaaaaaatctgttaagtgccggtatccgtaaggcgttgctgctgggcagtgcgctggccctgtcacagccgctgctggcggcggaaagcgccaacccggcgttgcaggcgctgttcgatcaggcctcttactggcatcagaaagcgcatgacgacctggcgacagcttcactgcaaaaggtgctgatggttgaacccaacaacactcaggcgctctacctgctggcgctctattcacagcagggtggcgacactgcggcggcggcgcagtatcgcgcccgtctgagtcaggtctcccccaacgatccgcatcttggcgagctggataacgctcgccagatgcagaccattccgcaggcgcagcttgcgctggcgcgtcagcaggcgcgcagcggcaacattccggcggcgttacagacctggcgcaacaccttcagcggcaatgcgccaccacccagcgtcgcggcagaatattatctcaccatggcgggcgaccgtacgctgctgccccaggcggttgaagcgctgcgccagtttgcggctcagcatccgcaggacaccggcgcacggctggcgctgggtaaagcgctgacctatcaggaaacaacccgtcgcgaaggcattgaggtgctgagttcgctggcgagcggtaatcaggatgccgatcgatcgctgcgtcaggcgctgctgtggctcggtccgcagccgtcagatgcggcgctctatcagacctggcagcagcgtcatccgcaggactccgccgtcatcgactactaccgtaaaaacgtcggcggcgcagaaaaaggggccggattcagcgcgctgaacagcggtgacgtcggcggtgcgcagtccagctttgaaaaagtactgagtgcgaatccgcaggatgccgatgcgttagcgggcatgggctatgtggcccagcgagccggacgttatcaggaagcggcggattatctgcagcggtctgctcagctcggcggcgatcagggttcatcgcgtcagcagcaggctgacgatgcgcgtttttatgcacagctggccagcgcccagcaggcactgaaaagcggagacacggcgcaggcgctgacattaagcgaaccgctggtgcaggctgacggcgaaaaagggctggccgccagactgttccgcgccgacgtgctgcgccgcaccaatcagccacagcaggcggagcaactctatcgcactattctgcaaagcgatgcggataaccgcagcgccaaagaggggctgttctacgttctgcgtcagcagaatcggggtgccgaagccagtacgctgctgggtgcattgccggacagcgttcgccagagcgtcacgccacgggccaatgaagccgatgcgctgcgtcagcaggcgaagcgtcaactggcggctggtaacaatgccgctgccatcgcgacgctgcagcagggcattcagcgctatcctacggatggctggctgcggctcgatttagcccggctctatcgtcagcagggcgacacgctgctggcggctaacgtgatgcagccggtgatgcgcaacggggccagcaccagcgagctttatgcaggggcacttaacgccagcgaaagcggcggctggcagcaggccagcacgttgctgtcgcgtattcccgctaacgcgaagacggcggcgatgcgtgaactggcgcagcgggttaatttcaatctgcagatgagcacggcagaccagtatctggcgcagggcgcgacggctgccgccgccaataccctgaaggcgctcacggttaatccacccaccaacccggttgatgccggaaacctggcgcagaagctggcgcaggcgggcgatctcaccagcgccgtttcggtggtgcggactaacctgcagcgtggcgtgcagggcaatgcgggcgattatgccgcgcagatgacggtactgaatcaggcgggcctcggcagtgaggcgcagcgcttcctcagcaacccggaactgcaggcgcgcagtacaccaacgcaactggccggtattcgcaatggctatctgattaacgaagtggatcgtctgcggcagcagcgtcagtacgcggtggcgtatgacaagctgattggtgcactgcagcaggatccgcagaaccgcgatctgatgttcgcgatggcccgtctctaccaggacggcaagatgaaccgggatgcgggcgtggtctatgactacctgatgacccaggatacgccgacgcaggatgcgcgcgtcggggccatcaacgtcgcgctggcgcagaacaatgtgcagcgcgctaatgagctgagtcgcggccttaacagtacgactcagacaccggatcgtctgctgctgctggcgcgggtcgcggaagccaatggcgagcattctcaggcgatgacttatctgcgttcagcgcgcggtcagctgattggcctgcagggcgcgcagcctggcagcgtgccgaccgtgggcggactggcgctggcggataatccgtttatcaaccgtgatacttcgccggtgggacgttcaccatccagctacggcaccgtgctgccgtggcaggcggcaccggcgggcgttgccgctggcgtgacaacgcagggcgaaccggccgcgggcagcgaaaccgttgctcaacagtcacagattctgcacgacgtcgacaccatgatggattcgctgcaggaaaaaaccggcagctggagtcagggcatggtgcaggtgcgcgggcgtgatggcgagtcgggcctgagcaagctgacggaagccaaagcgccgctgaccttctctaccgtgccgtttgaaacggcgcgcctcgactttaccgccacgccggtctcacttacggcgggcagtggcgcagccgatgcctggcgccgtttcggcaccaatgcgctgagtcagggcagggtggtggctgcaggcggtgcaacggtgaatgacctgccgaaacgccaccaccgattcgcaaaccgcctcaggtgtggagctgaatctggcgctgaagggcgacaggtataaagtggatatcggcagtacgccgctgggccaggatctcagtactctggtcgggggcgtacagtggtcaccgaaactcaccgacttcctgacgctaatcctgaccggtgagcgccgcgcgattaccgacagcctgctctcttacgtcggcgcagaagataaagccagcggcaaacgctggggacgcgtcaccaaaaacggcgctaacgcactgttaagctacgacaatggcgatgcgggcttctacgccggcgcgggcgcttacagctatctcggcgagaatgtcgccagcaacaacaacctgcaggcaactgccggtgcctacgttcgtccgttccacactgacgatcgcgagctgaaagtgggcatgagcctgtcgtggatggacttctcgaaaaacctcagctatttcagctacggtcagggcggctacttcagcccgcagaactatgcgtcggtctcgttcccgatagagttctcacgcaagtttgacgatttaaaagtcaatattggcggtgcagccggttatcagacctacagtcaggataagagcgcgtacttcccgtcggatgccagcctgcagtcagagctggaatcccttgccgccagcggcagcgtgaaagacgcttactactccggcggcagtaaaaacggcatcggctacaacctgcacgccggggcggactacaaactcaataaagatgtgacgattggcggccagctgggttatgacacctttggtgactacaacgaaagcagcgcgcagctctatgtccgttacctgttcggagagaagtaatgagtgagcattcggggttatcgcatccttatcagccaggctggtttgacctggtcagcgtgctgattgacgggatgatcgccaacgccggtcatcaggaggcggaagcctttctctataagatgggggaatcgctggcgacccgctatcctttgccagagtcgcgtaccgtgcaggatctggagcgcgagtgcaatctgcaactggcgcgttttaactggggctttgtgcagcttcagccggaagagaaggcgctgctgattgcgtatcacgccttaccggcaggcgacaacatccactctccggctgactggcaggcggcgtttggtgcggtgatggccggacttttttcgggctggttgcagggccagggcggcagcagcattgtgccggttacgcttgaactcaacgatggcagcacgctgcactatcgatatcaataggatcggaaatgaaacgtaatccactctggcgggtctggctctgctctgttttactgctggcctgcagcgcgcaggcgagtgccagcggctgggagacttttaaaagtcgctttgtgacctcagaagggcggatcactgataccgccaataacaacgtcagtcataccgaaggccagggttatggcatgttgctggcggtggccaacgacgatcgcgccaccttcgatcggttgtggcagtggacgcgcagccagctgcgtaatccgcagaccgagctcttctactggcgctacgtgccgggcagtgacaacccggtcgccgacaagaataacgcctccgatggtgatgtactgctggcctgggcactacagcgtgctgcacagaaatggcaggtggagagctaccagcaggaatctgaccgtattcagcgcgccattatcaggctggatgtcacgagctttggcggccacaccgtgatgctgccgggtgcgcagggctttaacaaagtcagttatgtggtgctcaatccctcttacttcctgtttcaggcgtggcgcgagtttggtgaacacagccatcttcagatctgggataagctgattaacgatggctttgatctgctgggtaagctgagctttggcaaaaccgggctgccaatggactgggtcgcactgaatgccgacggttcggttgccccggccgtcggctactcgaaccgcttcagttacgatgcgattcgcgtgccgctgaacatctggtggtatgacccgcacagtctggcactggtgccgtttcagcgcgtctggcagggttacagccgcatgctgacacccgcctggttcgacgtgctggcgaatgccccagcaccttaccatcttgagggcgggctgctggcggtacgtgacctgacgctgaatgaaaccggctatctgagcgataagctggctgcggatcagaactacttttctgccagtctgcagttgctgacctggcaggcgtttcaggagaagcgctgataactggcagaatggcggcactggccgctattctgccatcgacagccacgcgctcaacagggagcaggcgccgcgcctgacccgcctttaactgccgggtcacggctctgcaacccggcggttacgcgttactgcggataggcgacccagtcgccgccgttcagcctgatccagggtttgccctgatacattatcaccactgcaccgtcattttccgacaccaccggcgtctgtggcagcttgtcagtcagcaccgacatattcacattcggggcattaaatacctgcccatctacgacgcgcgacacaatctctgacaaggccagcaggctggtcggcgcatcaatgttcaatggctgagcctgatgcggcgccttcattccgacgaacttaatgcccaccggtacgtgagtaatatccgggctgggaatatcgcgcaggccggacatctgcattttgtctccctgcagcgcggcaccgtgctcgggcactaccagtaccatgacgcggcggcccgacttctccagctgcgtcataaaggcatcaagctgatcgaatagtagttgcgcgcgcggtttccacggtgccgttttggtgctgccgagttcacgggtgccgtcgtgcagcgggatcagattgtagaaggtggcgctgcgtgcatcgctgcttttgctgcggtcgtccagccagcgctgcatcagttgcgcatcgttgaataccggcgagccgtcgaatgatgtcagttttctggtgcgatacccgcctgtgacatcagcggtgcctgaatatcgccgccctcgcgcacctccttcaggtagttaccgaataccccagtgtgatccatcatcaactgctctttaaagcccagcttcgccagattgtcgaacagatagcaacgcggatcggcaggtttatagagatcgctatgcgaggtctggccacaactggcacgcagcagtcggatacccgccggtccgctgtagctggttgcggcgttgtaattgctcagcatgatgtcgaaatgctgccacagcggatggttacgcagctgagaagcatccatatcagaccaggcgagcgaacagatattgatcaccaggatgtcgaaaggctgcgaatctgcgggcagattgtcgggaaaatgcgtcacgcgctggcgttcactttcatgaaagcggttcagccaggcggtgagattcgcgctggtcggcggcgcagactgctccagtccatccggcgtggcggctggctggccgccgctgggtgtctgattcaatacgacctgtggcgtagccgtccgggtcggcagcagcgacatcgccgggccagcaatcgtcagcacgttaagccagatcagcatcagggaaaccagcactgtgatgcgaacccattgtgaaacaaacagatagagaaccagcagcacaaaggcggcccccaccatttgccagttaataaagcgatcggccaggtcgagcagataggccgcagagaagcccgccagctgatcgccctggctgagtatgctgctgagccctggcagccaggtgtcgtgccagaacagcgcgatgccaaccggaatcgagatcaactggcggatgcgatgcaggcgcgccgagggtaacggaaaaagcagccaggcgagaaacaccagattgctcagggcgtgaaaattgagatagccataccacagcaggccgaatttcagtaaaaagtagaaattccagccgcccagtccgcgccaggaggaccagaagcgggaagaggaggccgccgcgggttgatcagtattcattaattttttctatccgtttcagaggattgacgctgccagtgaccttccgatttaagcgcgcgcgctggcaacaaacgattcatgatgccgttccagcgatggggtagccatttttgatataatggctttaaaaacagcaagataaccagaataagtagcgcaatttgtacccagtccatcagattcatcaggctttgttctccggcagtaaagtgatgggctgcggtgcagcgcgttcatgtgtttcaggccggctctcaacggcggcgcgggccgtttctgataccggagccagatcctgaattgccatcggcgtcagtttcttaatattgctgacttccgcgaggatctgattatcttcaaaccagaccatccggttagcaaacagctcgtcgtgaggcagagaaaagatatatttcaatgccttatcaaggtcgttatagcggcaggaagagaggaaaaggatgacacgatcttccagtaccgtgaccaggtcgccaaagcggcgcggtttacagagcgtcaggatttgctgaggcttaagctgtggcacaggccgcaacgcgaccagcaggcccttatcattttccggcagcagggtattgctgatcaactggccgactgactgacagaaggcatcgagacgcaggtagcctttctcatgcagaggctgcaacgaagcggttaacgcctcaagactggcgggaacgcgacggttaaacacctgtccctgaaggccctccagcgtggtcagaaagcgcgacagtgtggcgttggtcgggacgatggcgtttacaccgcaggccagcagcagacgtttcgtcgctataacgcaggcttgcacccatctcgcgcaccacaattttcagtccgttgccgcgtgtacgacgcaggctgtgcaccatcttcgccagttcgttgatatattcgctgcgggtcaggctgaaaatcaccgttgcggcattggcctgctgcgcccgcaaccagacctgctcattatcctcgaacagttgccactggcgtgaaagcggcggcgcgccctccagcacgatgttgtccgcaagataatgctgctcgtcgttgaggctcagcggttcctgcttttcatttaaggtaaaaaagcgttcattttcacagcccagacgtattgcccgatcggcaagcaggcgttccgcggcataccaccagttaattcgatactgccagctatcctgctgaaagctcaaatgcgcaacgccatccagctgacgaaaataacgctgaagatgattactcagatttattattgtggtgccggaggtcacgattaaaagggtgagctttcttttatgcagcgtctgacgcatgccctttatccagcgggataattctgcgtcatcaagcttatcccattgcgctgcgttgctattaaatatcactaacccatttttactgccgagcgtgcgcagaaaatcactttccagctgcaacaaactgcctttgcttttggaaagagaaaacagcggaatacgatcgggtccgccaggtgggtcgggcgtcagcaaatcacgcggcggctggtcagcgctgatcagcgttacggcctgctgatgtgaaattacctgtcgaataaaagtgcgggcgtcatcctgccgcgcacaggtcacccaataacagccaggcgtttgcaatgccgttaattcaggctgaacatgcaacagccccagcgaaaaagaatttttcatattgaattcgttatttttccagtccaggctagcttattatagacaggccgggatgtaacctgagaaatttaaacattgctaatcacaggccggctcacattgttctgcaattgccgcgtttctggaaatatttttcaactttcctttacgcgtacgcgcagtcggtcatcctgagtgtgacgttgttttatttttggcgaacagtaatgaaaaaccacaatctctataaccctgttgccgctgatggcgatcgtcaggatgatattagcgcgttgcgcgatgcgttttctttgcactctttccgctatgtcgacattgcgcgtgaagagcgcctgaaagcgatcgtgtcgcgctggccgctattagcggaaacccttgccagccagtctgagaccgatcgctgatgccacagatcgcgcttcagggcgtacggggcggcgtcggcacgacttctctttgtgccggattaggctgggcgctggcggcactcggcgaacgagtattgttgatcgatggctccccggtcagccagctcggcgtgcattttaatctgcccgctcagcaggataatggctggatgaaagcactgtgtgagggcggtgactggcagcacagcgggcttcgctatcccgatggtcctgatttgctgcctcacggggtgctttcccatcagcatgctttgactattgccagacagaatgaggcgatcgccgcgccgctgctccaggcattaccggacctgcgggcgcgctatcagtggattattttcgatctgcctgccgataccctgccctggcatgaaacgctctatccgacgctggacagcctgttgtgcgtcactcagccagacgcgaattgccatttacggcttagccagcgccagtttccggcgcgcactcgttttattatcaatcagtttaatgccaacagtcgtctgcagcaggatctgcatcagctctggatggcctcgctgaatccgctgataccgctgctgatccaccgggatgaggcgctggcagaagcgctgatgatgaagcagccggtcggtgaataccggccacatgcgttggtcagtgaagagatcatcacgctggcaagctggctgctgctcaatctgaatggagtgagctcttgaatccgttgtgctggctgttaacggcgcccgcctggcaatcgctgcacaggggctataccaccgcgcgaggcaatggcgcgtcccgcttcgccagtgcgctccatctgttctggtcggtgctgggcctgatgctgcttcgcttcgaaacgccaggctggcagcggattattcagcagcgccgccggctctatccgcacatttcgccggagcggccgcgaccgctggatatcctgcgttatctgatccagacgctgtggcttttggtgatcctgccgcagagcgatcgcgctcgtggcggtttccgtggcctcggtgcgctgtctggctggcgccaccatggctaccgctggctggacaaggccgttgcccactcacagacccagggaatcgatgtgcgcatcgaacactggctgaagcggctgtcgccgctggtgcgacgcagcctcttcgccgtcactgccctgtttgccacgttgctggcgctgctctgtatcagccagccgtttggcctgatgacgcagtttatctttgtggtactgctctggagtctggcgatgctggtacgacgcatcccggggcgtttcccgaccatgatgctgattgtgctgtcgctgaccgtatcgtgccgctacctctggtggcgctatacctcgacgctgaactgggacgatccgctgagtctggtgtttggtctgctgcttattgcggcagagacctacgcctgggtggtgctggtgctgggctattttcagacgctctggccgcttaatcgtcagccagtatcgatgcctgtcgatcgggatcagtggccaggcatcgatctgctggtgccaacctacaacgaaccgctcagcgtggtcagacccaccatctacgctgccatgggcatcgactggccgaaagaccgcctgaatatctatctgctcgacgacggcgaccggccggaattccgcgactttgccgccagcgtgggtatcaactatgtcgtccgtcccacccatgagcacgccaaggccggcaatatcaatcacgcgctgaaaaagtactgccgcagcgaatttgtggtgattttcgactgtgaccatgtgccgacgcgcgcctttttgcagatgaccatgggctggtttattaaagatccccggctggcgatgatgcagacgccgcatcacttcttctcgcctgatccgtttgagcgcaatctcgggcggtttcgtcgtacgcccaatgagggttcgctcttttatgggctggtgcaggacggtaatgatacctgggatgccacctttttctgcggctcctgcgccgtgctgcgccgcagcgcgctggatgaaattggcggtattgcggtggaaaccgttaccgaagatgcccatacctcgctgcggctgcaccggcgcggctacacctcggcctacatccgcattcctcaggcggccggactggcgaccgaaagtctgtcagcgcatatcggacagcgcatccgctgggcacgcggtatggtgcagatcttccgccttgataacccgctgtttggtaaggggctgaagtgggtacagcggctctgttatgccaacgccatgctgcactttctctctggcattccgcggctggtcttcctgctggcgccgctggcgtttctgctctgtcatgcctacatcatctacgcacctgcgctggcgatcgccatttatgttttgccccatatgctgcataccagcctcaccaactcgcgtattcagggacgctggcgacactctttctggagcgaggtctacgagacggtgctggcctggtatatcgcccgacctaccaccgtggcgctgttcaatcctcataaagggaagtttaacgtcaccgcaaaaggcgggctggtagaggaggagcatctggactgggtgataaccaagccctatatgctgctggtgctgctcaacctcgcaggggttttgatggcgttctggcgcatgcagcacggtccggccaatgaggtactgacggtatgggtgagcctgatttgggtgctctataacatgattattcttggcggtgcggtagcggtttcggttgaagcacggcagatccgtgaggcgcaccgggtggagatcgccatgccggccgccattgcacgcgaagatggtcacatgctgccctgtacgctgcgtgactactctgacggcggcgtcgggctggagatgcgcgagccggatgcgctgcgggagaatgaaaaagtgtggctgctgctgcgtcgtggacagcaggagttcagcttcccgtgccaggtgcagcgggtctttggccaccgggctggcgtgcgtctccatcagttgaccactcagcagcatattgaatttatccagtgtaccttcgcccgcgccgatacctgggcgctgtggcaggacggttttccggaagataaaccggtccagagcctcgccgatatcatgatcctcggtttcaaaggttacctgcgcctggcggaatatggcccgccgcagttacgtcggctgtttaacctgcttaccgttggggtgagctggctggcttcgctgttgccgcaaggcatcggacgtgtgccagcttcaaaaaacgcattgagttgatgatatgacgataccgagagtaaacaggtggtttgccgctctgctgctgggcagtgcaacgttaagctgtgccgccgcgcaggaggacgcgcccgcaaacatcaatggtgtaacgcctgtgcaatctttaccgcaggataacggcgcaccgctgcggaacagccaactgagctttgcccagctggcaccgccgcctggcagcatgacgctgcgtggcacccgcactaccggacagattgagttcggtgtgcgcagcgatgaggtggtgacgcgcgcgttgctgaacctcagctttcggccttcgcccgcactgctgccaacgctgtcgcagctgaagatttatctcaatgatgagctggtcggtctgattaccctgacgccggaacagctgggcaaagagatccagacgcagctgtcgatcgatccgcgttacatcgccgactttaaccgcgtgcgtttcgagctggtgggccactacgccaacgtctgtgaaaatcctgccaatagcgcaatctggctggatatcggcaaacagagcggcatcgatctgacgctgcaaaaactgcccctgaaaaatgacctctcccacttcccggaacccttttttgattcgcgggatacgcgaccgctgaccctgccgatggtgttcagcgcccagccggatgtcacgcagcagcgggctgccgccattcttgcttcctggtttggcagcaaaacgggctggcgcgggcagcgtttcccggtgctgtataaccagctaccgcaacagcagcatgcggtggtgtttgccaccaacgatgcgcgcccggatttcctgaaagatctgccgccggtggcgaaacccacagtagagattgtcagccagcccgataatccgtatgaaaaaatgctgctgattctgggacgcaacgatgaggacctgctgacggcggttcagggtatcgcccagggtgagctgctgctgcgcggcgatatctcaaccatcgacagcgttaagctgctctccccgcgccaggcctatgacgcacctaactgggtgcggaccgatcgccgcaccactttcgccgaattgacgcaatatgagaatcagttgcagtctgatggggtgcagcctaatcccgtcagcctgaccctcaatctgccgcccgatctcttcctggttcgcgcgcgcggtatcgacatggatctgagctatcgctataccgcgcctttccagtcggatggctcacggctggcggtcaacctgaataatcagttcattcaggattatccgctgccgccgaaaaatacgacgggtcagcagctgctgcatattccgctgattcagggaatgctggacaagagccatgagctgctgattccggcgctgcgcctcggggtggtgaatcagctgcgcttcgattttgattacgccaacatcaccatcagcggcaacgcggatggacgctgcgaaactgtaacgccgattacgcatcatgtggtggtggacgacaattccagcatcgatttttccggctatcgccactacatcgaaatgccgtcgctgcgcgcctgggcgaatgcgggctttccgttcagccgctacgccgatctggcgcaaaccctggtactgatgccgccaaaacccgatgcagagcaggtcagtacgctgctgaatacgttgggcaatatgggggcgcaaaccggctatccggcgctgcgcgttcagttgaccgatgactgggccacggcgaagaagcaggatgtggatctgctgatgatcggcgtcatccccaaagatcttcaggatgaccagcggatcccggcgctcgttgacgccaccgccagctggctgaaagagcctgtgcgacaaatcactccggaggtgaacccgcaaagtcagcgcgagcaggcggcagaaagcacgacgactatcagctcccgcggcccgctggcaacggtgattggcttccagtcacctttttacgatcagcgcagcgttgtcgcgttgctcgccgatggtacgccgcgcagctggcagttgctcaacgaggcgatgggtgacagcggcaagcgtggcacgatgtctggctccaccgtggtgatccgcgagtcaggggttaacagtctgcgcgtgggagagagctactacgttggtcatctgccgtggtgggagcgtctctggtcgctactctccgtccatcccttctggctggcactctgcgcactctttgtagtggtgctgtttgcgctgatgacctggcgtctgatgcgaattattacccgtcgtcgtttactggatgaagatgaataacgcacaggtgctgcgggcaggcatgctgctcggcgcactgagtgcgctgccggggctggctgcaccggtcgacggatcggaggtgtcgccggtcgaatggttgctgtcacaggtacgcaccggcgagtcgaccaacaaatatgatctggtgcagcaatcgctctaccggcttgagaagatcgatcccgataatccgcaggtgctggcggctcgcctgcggctggcgctgcgtcagggcgatatccctaaagcgcagatgctgctggagcagctgaaaaaggttgcgcccgactccgccgcgacgcgtgaatccgccgtcggcctgacgctgatgtcgtcggatgggcgtcagcagctgcagcaggcgcgcctgctcgccacctcggggcgcctgacggaggcgaaaagtgcttacgatgcattgttcggaggggtttttccggatgcaaacacggcgctggaatactggcggctgctggcacgcattcccggtcaggagagcgtcgcttaccagcagctgcaggcgctggagcagcgctacccgggcaatatcggggttgagttgcaaattgcacgcatggcatttgatcaacagcagccggaacaggcgatagcgcagttgaaaaagctggcaaacagcaatggcggacgcgccgctgccgccgatctctggctgcagcagatcaacgatcagccggtcagtgacagcagcgtggcgcagttaaatgcctacctggctgtttttaccgacggcgacgcacaccagcagggcgcggatgtgctggcgaagcagcaggcgcagctcgccgatcccgcctatcgcgagcggatgcgtggcctggcgctggtcgaggcgggcgatgtgaataatgcgatggcagcgcttagccgggcactgaaggataaccccaacgacgccgaactgatgggtgcaatggggcagactcaggcacgcgccggccatcgtgacacggcggtgctctggctggaacgcgccgttgaggcgggcaagcagagcacgctgatcggcaaatggcagtcactgctgcagactaaccgttactggctggcggtcgaacagggcgacaaggcgctggcgcagcatgacgttgagggggccgaacgcgcctaccgcgccgcacagaaaattgatagcaccgacagctatgccctgattggcctgggcgatgtggcgatggcgcgcaaagatgcggcaggtgccgaactgttctggcagcatgcgctgcggctggacgcgaccaacaccaccaccgtgcgtcgcctggccgggctttatcaggccgagtcgcctgcccgcgtcatgcagtttatcagtacgctacccgccgggcagcagcgcgagatggcgggaacgttgcgcgcgctgcgcagtgacagcctgcgcgccgaggccgatgcactcgcccggcagaataaatggccgcaggcggcagagaagtatcgggcggcgctggcgctgcagccggatgacgtctggctcagttatcggctggcgagcgcgctacgcgacggtggggccaccaaacaggcggatgcgcagatcgcgacgctgcaacagcagcatcccggcgatgcgaccgcgctctacgccgccgcgctctacctttccagccgggataatgatgacgccgcactggcaacgctgcatcgcctgcctgaaacgcagtggaacagcaatatgcatgagctggctgaccggctcgggcaggataaaatttttgccagcgccgaagcgcttcgtgcggcagggcaggagcgggcagcggtgacgctgctttaccagcagccggtttccagccgacgcgacctgacgctggccgactgggcgctggctcgcggggacgcacagcaggctctggagatctatcagcaggtgctgtcaggtgaagctgacaacagcgacgcagcgctgggacgaatcgaagcgctggtcgcgctccagcgcaacagcgaagcacgacaggcacttgagcagcagccagcccagcccaacactcttaatgccgatcgccgcgccgcgctggcatggcaggcggtgggcgaaaccacgcaggctgccgtgcgctttgccagcctgaagcagcgcgctgcgtcactgccgccttcgcaggataaggcactggtgtttcgtgatgcggcacggctggagcgcgcgcagcagcagccagagatcgcgctggcggattatcgtcaggcgatgacggccagcggtatcggcagcggcgaaagtatcagccgcgcgacacgctctcaggaacaggatgactggctgaagcgcagtattcgcagcgacaccgcagatctctatcgtcagcgtgagaccacgctgacggtgcagcaggattattcgcgcaataagggtacggctggggtctccgactttactgcccataccaccatgctgcaggcggaaagtccgtttgccgacggacgcggctttttccgtctcgaccgggtggacgtctcggcagggagttttaccacccgtaacggcagcttcgacgagcagtttggtagctgtgacgacgccagtttccggcggatgcagccgcgatgccagtcagcgcgccgagggcactgcgctgggcgtcggctggcataatgaccgctggtcagcggatctgggtaccacgccgctgggctttgaggtgaccaactggaccggcggcctgagctggaaaactgacgtcagggatctgggcgtgacgctgaccgcctcgcgacggccgatcgccagttcgctgctttcctatgcgggcgcgcgcgatccatcagccaacggtggaaaaagctggggcggcgtagtggcaacgggtggcagcatcgggctgagttacgatcagggcggcgcacacggtgtctggggcgacatcagtgcgcatcagatcaccggtaaaaacgttgcggataacagtcgcgagcgcttaatggccggctactactacaagctcattaatagcgataatcgccgggccaccgtcgggcttaacagtatgctctggcactatcagaaggatctcagcgattacaccttcggtcagggcggctactacagtccgcagcagtatctctccttttccgtgccggtcacctggcgacagcggacagaaaactggtcgttcgacctgggcggctcggtttcctggtcacattcgaaaaccgatgcgcagcagcgctatccggtcaatcccggctttacccttgccagcaatcccgtttccgccagcagcaccggcagcggcacggggtatacgctgcagggcgtggttgaacgtcgtatcacgcccgactggtttatcggggtgggcgtcgatattcaacaggcgaaagactataccccaagtcatgggcttatctacgtgcgttactctgccgctggctgggaaggggatctggatatgccgccacagccgctgaccccttacgcggatttcaaataatcccggcctggaaaaagccggacttttcagacggtaaaaaagtcagtttatgggatatactggcgggcattgtactgtctgctatctgggcttttttcatcgtcaggagaatatttttgcgcgtaagccggtcacttacgataaagcagatggcgacagtttcgctggttgcggttatcaccatcagcatctttatcgtcatccaactgtttcattttgtgcagcagcgcaggattgactacgcccagcagatggagaatatcgcacataccgtccgccagccgctgtcggaagcggtactgcgcgccgatatttctcaggccgaacgcattctccattcactgaaacctgccggtattttatcgcgcgccgatgtggtgctgccgaatgcgtttcaggctctgcatgctgacttcgaaacggagaaaccggtgccgcgtctggtggcgcgactgtttgagctgccggtgcagattaccctgccgctctattcagtggaaaataccgggatgccgaaaccgctggcctatctggtgctgcaggctaactcgacgcgcgtctaccagtttattctcagcacgctctcgaccatgattatcacctatctgctgctggcactgatcctgtcagtggcgatcagctggtgtatcaaccggctggtggtgcatccgctgcgcaatctctcgcgggagctgcaggaactgccgccgcagtcgattctgacgcataagctgtcactgccgcagagccaccgcgatgatgaaatcggcatgctgatccgcagctacaaccgcaatcagcaggtgctggagtcgatacatgatgagatgagccggctgaccacccattttcccgtgaccgatctgcccaaccgtaccctgtttctggcgctggtcgagcagttcatgagcagcccggaacagccgctggggctgatggtgatccgcattgaaaccctgcaggaagccaatggcgtattgagcgatgagcagcgcgatacgctgatgctgacgctggtggagaagatccgtaatacgctggatgaccatactctgctggcgcagaccgggaccagcgactttgttctgttaatgaagcgcgccattaatccgtttccgcgccctgcgtctggcccgtaacctgatgattcgccttaatcagccggtcaacctttatcagctgcagctgcgtcctaacgtcagcattggtctggcgctgcgcgatgatcagccgctgagcgccagtgatctgcttggccgcgcgacctcagcgatgatgtcggcccgtcatcagggcaaaaatcagattctgttctttgacgccgcgttaaccgagcgcgcgcaaaaacgtctgacccaggagcatgacattctgcaggggctgcacaatgagcagttcgccctctatctgcaaccgcaggtcgatatgcgcaccggcacgttagtcggcgcggaagcgctgctgcgtatgcgccagccagacggcagctacggtctgaccgaagagtttattgccagtgccgaagagattggcgtgattagcgcgattggccgctgggtgtttgaagaggcgtgccgcattctggcaggctggcagcgacagggcattatgttgccgctgagtgtgaatatttccgctgtgcaactgcgtgacacgggcgtggtctctcatctgcaatccctgctgacgcgccaccgcatcgcacctggcaccttcgtgctggaagtgacagagacggctcagcttgatgatgctgaacaggcgatatcgatgctgcggatgttgcagcagaccggcgtagccgtggctctggacgatttcggcatgggctactccaaccttaactacctccatcagctgaaagcgttgccggttaacaagctgaagatggatcgcagcttcgtggcggcgctgccgcatgacgacaccatggtctgcatcgtggcggccatcgccgagattatccatctggaggtgattgccgaaggcgtggagacagcagaacaacgtgactggctgctggcgcgcggcatctctatcggacagggctatctgtatgctgaagcgctgcctctgacccgattcaatcaggcatggatcgaaaactcctcactaccgcaataattgcctgattcattgattttgcgagaattttagttacaaaaccccttgctgaagcgtttcagttcagaattacgatccccgggtttactgggcgtttgtcaccctgtattaatcacgtaaacagagtgttattttcgggttactgtcaggcgccacctctgttgcccgccagtcacaataacgaatccgacaacatcacctcacggcgttagtggacacctgtttatgaaaacctcactttttaaaagcctttatttccaggtgctgatggcgattggcatcggcgttttgttaggccatttttacccggagttagggacccagatgaagccgctgggagatggctttgttaagttaatcaagatgattatcgccccggtgattttctgtaccgtggtgaccggcatcgctggcatggaaagcatgaaagcggtaggacggaccggcgcggttgcactgctctattttgaaattgtcagcaccatcgcgctgattatcggcctgatcgtggtgaacgtggtgcagccaggtgccgggatgaacgttgatcctgccacgctggatgccaaagccgtggcgatttatgcgcaacaggcagaacagcagggcatcgttgctttcctgctggatgtcatccccaacagcgtgattggcgcctttgccagcggcaatattctgcaggtgctgctgtttgccattctgtttggttttgccctgcatcgtctgggtaacactggcacgctgattttcaacgtgattgaaagcttctcaaaagtgattttcggcatcatcaacatgatcatgcgtctggcaccgataggggcatttggcgcgatggcgttcactatcggcaagtatggcgtgggctcactggtgcagctcggccagctgattatctgcttctacatcacctgtattctgtttgtggtgatcgtgctggggctgattgcacgcctgtttcgccggattcagcatctttaagttcatcgcctatatcaaagaagagctgctgattgtgctgggcacttcctcttccgagtctgcgctgccgcgcatgctggataagatggagaagctgggctgcaagaaatcggtggtagggctggtgatccccaccggttactcctttaacctggacggcacctcgatttacctgaccatggcggcagtatttatcgctcaggcgaccaatgcgcacatggatattttccatcagattacgctgctggtggtgctgctgctctcctccaaaggcgcggcgggggtaaccgggagcggatttatcgtgctggcggcgacgctctctgcggtgggacatctgccggtggcgggtctggcgctcattctcggtatcgaccgctttatgtccgaagcccgtgcgctgaccaacctgatcggtaacggtgtggcgaccgtggtggtggcgaagtgggtcgatcagctggatcataaacagctgaccgacacgctggcaggccggaataaggagaataaagcgtctgaatcttcaatttaatcattgaatttcacttaaatccccacaaatgcccgctgtcgcttgccctgacagcgggcatttgcataataaaccccacttgttttttttgacgtttttcacttcgttacgcgacatcctgagcttcctgtggtcaaacactttgttgttggataacagcgcgattcggcgccagccgaatcgttaataacagcggcaatatgcgccagtgataacgatatttgaattatttgagtaggggttcacatgcagggcaccagaattcggcttttggttggtggattagtgctggcaagcagctttggtctccaggcagaaacgctgcaaccggatccggcctggcaggaaggcaagctggataatggatttaactggcagttactggccacaccgcaacgccccagtgaccgtattgaactgcggctggtggtgaataccggctcgctggtagagagtgcgcaacaggccggcttcagccatctgctgccgcgtctggcgatggtgcacaacaccgcgcttgataaccatcagcagcgcgcgctatggcaacaggcgatggatcctcagcatccgctgccacctgtgatcacctcctatgattccacccaatataatctgagcctgccgaataaccgccccgagttgctgaaagaagcgctgaactggctggcggccacggcaggcaatatggccatcaccgaacaggtggtcaataccgcgctggcggcatcggatccggtggcgacctggccgaaagatacccaggatgtctggtggcgctaccgcctgaaaggctccgcgctgctggcgcatgaccccgcagcgcaaccacgcgcgccggttgatttaacccagctcaatgatttttatcatcagtggtacaccccggatgcgatgacgctctacgtggtggggaatgttgacagccgcaacctctctgagcagatcaataaaaccttctcggcgttaaccggtaaacgagaaacgcctgcaccactgcccaccctgtcgccgctgccacacgagccggtaaatctggtcagcagcaacatgacgcaggatcgcctctcgctggtgtgggatacgccgtggcaaccgattcgtgactcccagaatctgcagcgttactggcagggcgatctggcacgtgaagcgctgttctggcatgtccagcgtgcgctcagtgacagcaaggcacagggcatacaggtgggatttgattgccgtgtgctctatcagcgtgcgcagtgctccatcaacctggatggacgcaacgaaaatctggcgcagaatatgaatctggtggcgcgtgagctggcaaacgtgcgtgacaaaggcttgccgcaggaggagtttgatgcgctaatggcgcagaagctgctggagctgaacaagctgtttaccacctatgcccgcaccgatacggatgtgctgatgagccagcgcctgcgctcccagcagaaacgccgtagtcgatatcgcacctgagcagtatcagaagctgcgtcagactttcctggccggcctgacccgcgaacagttaaaccaggagctgcgtcagcagctgacgcaggaactgatgatggtactgattcagccggaaggcgaagcggaaaccaacgtgaagagcctgcaaaacaactgggacaaagtgatggcaccaccagcggcaccggcgaccagcaatgaagccagtccgccggatagcaacgtcaaagacgttccgccagccgcataaagtcaggtttttgccctgagccactcggtcactaacatcggccagctggcgaggggcaaatctgccacgccgcggataccaaatccgtgcccgcctttctgatagaaatgcacctctgccgggaccttatgctcacgcagcgcgccaaaaaacgccatgctgtgattcactgatacatcatcatcgtcggctgcgtggatcaacagcgttggcggcaccagcggatgaacccgggtttccattgaataagcgtcaatggttttctgatcgggccaggcacccaacaggcgggttctggctccttcatgggcgatgccgtcccgcatgctgattaccggatagaccagtaccatcgcatccgggcgcggcgagaagttttctgcgccatcctgcaccggatagagtttctctgcgaaacgcgtacccagactggcagccacgtgaccacccgccgaaaagcccatcatgacgatatatttaccattcaggccgcgctgcgcccgttcacgcaggacgcgtaccgcgcgctgagcatcggccagcggcgcgtcggggccttcgtgatgtccatcatagggcaggcgataggtcatcaccgccagggtgtaacccattgaggtaaaaaatgtcgccagggcgctgccttcacgatcgatcatcacgcgctgatagccaccgcccggtgcgaccagcagggtaatcccgtttgattcgaccggatgccagatcgccatctccgggcaacgtacgccggtagcgccccgatcgtaaggctcatactcttttgccatgtcgacaatctgcggctgtgcgcgcgaatcgctggcgcctggcgcatcaccgtgtggccagatattaataatttctgtgtgcataaatagatcctgatgcggggaatattttaattgttttgttcgcggccggagagaacagcgtcctgctgtcttttgattaaaagatggtcttttttcaggcagtcgtccatccgaaaaggggggatctgaccagattcggactatgcctggtggtggatctgtttgtttaacttattaattttaatcaataaattataagagagattgaagggggcgaccgcaggggatctgttattaaccacaatttttccgcttaaggtaaatagctggcacggcccgctttattagccgcaatttaccggatatcacgctgtgcgttcttaaggcgacataatgattttagcgtcaggatcacaccgccacgctgcaggggctaacgtgccagtctcatctgggaaacggatagcatcggttacagtcacgcagccagacattaccagcagcctaaaaaaatgcgccctcgggcgcattttctggcatcggcacgatcagtgcctgtatcaacgacgctggctgccgctctgtcagtcaggcatcgcctctgccggaataattgcgccgcgatgctgaatcacggtgctggcagtcaggtgtccgcgctgcgcggcgacctctgcagaggcgccggtcagacggcgagccagataaccggcactgaacgaatcaccggctgcggtggtatcgatcactttctctttcgccagacgtaccgcaggtacatcaatcagcggtgcgtcgccggtgaccaccaggcaggagtctgcaccgcgcttaatcacgatttcgctggcacccgcctgacgggtacgcgcgataacgtcatccagcggctcttcgccccagagcagatgttcatcatccagtgtcaggaaggcgatatcggtgcagttgagcatggcgcgataagcggcctgcgtgctggcccgatcggcccataaacgcgggcggtagttgttatcgaaaatcaccttgccgccattagcccggcagcgcgccagcagcaccatcagcttttcacgactggcaggcggcagaatcgccaggctgatgccgctaagatagagataatcgtagtgcgacagctgttcagctatctctgctgattgcggactgtcgagccagtaacgcgcggcggcatcactgcgccagtaccagaaggtgcgctcaccgtcggcatcggtttcaatgaaatacaggcccggcattttattatcgagccgctgaatcaggtcagtattgaccttctcctgctgccaggccgcgatcatttgatcgctgaacgaatccgtacccagcgcagtgacataatcgacccgtaactgctgctcatcaacctggcgggcgagataaacggccgtattgagcgtatcgccgccaaagccacgtttaatgttctcacccttttcggacagctcaatcatgcattcgccgatgatggcgatttttttctgcgtcatggtttcagacctgtagtgaaatatcgccttagtctcgcgtctggtatggcagacgtcaatggttttaaaacagtgttttaatttaccttttaaggcggccattagtcccggtctcggggataaacgccgggaatgtcggctttttttaccgcttatgctaacgaaatggctgagaaacccctttttctgaattgaatcatcttactatcccgcttccctgatgccgttgcccgcggtctcgactatctttaacgcagaccgtgaatgtgcaaggagaaagcgtaatgtcgcgtaccgggaaaatagtcagctgggtagcaggaattctggtgttgttgatcgtggtgattatcgtcgtcatcgcgacctttgactggaatcgcctgaagcccaccatcaatcaaaaagtttcaaccgagttaaaccgtccctttgcgatacgcggggatctgggtatcgactgggcgcgaaatcgcgacgaggcaggctggcggcgctgggtgccgtggccgcagatccatgcagaagatatcatgctggggaatccgcctgacattgccgacgtcaccatggtacatctgcagcgggtcgatgccacattgtcaccgctgtcgctgctgcacaaagaactgttcatcccgtggattaaattgcagcggccggatgcgcgtctgatccagaccgcggataaaaagaacaactggacctttacccttgccaatagcggcaaggatgagaagagtgctgcgccatcggcctggtcattccgtctggataatattctgttcgatcagggccagattcgttatcgcgatgccattaaccgcgcagatgtcacggtgcaggttaatccgctgggtaaaccggtgccgtatacgcagattgccggaggcaatgaccagcagaagggcgcaggcgacttcgtctttggctggcaggcgaagggcacttataacaatgagtcactcagcggcgacggtaagattggcggcatgctgtcactgcgcagtcagaacaccccgtttcccgattcaggccgatctgcgcaacggcaccacccgcgttcaggtgaccggcggtctgcaggatccgatgaacctcggcgggcttaacgtgcgactgcgcttctcgggcgatacgctggccaatctctatggcctgaccggcgtcctgctgcctgacacgccaccttatgaaaccgacggccatctgattgctaaattcagcggcgaaaagggcacggtctaccgctatgagaaattcaacggacatattggcgacagcgatattcatgggtcgctgatctacagtcaggttaaaccccgcccgacactcagcggcgagctgacctctgagcaactgcgcatggccgatctggggccgctgattggcgtcgactctggcaaaggcagtgaaaaaactgcgcaggccaaagcccggcgcggggagaaatcgaatcagcccgcagaccgcgtgctgccacacgataaattcgaaaccaaaaactgggacgtgatggatgccgacgtgaagttcagcggcaaacggatcgaacacagcaattcactgccgttaagcgatctctatacccatttacagctgaaaaacggtgatctgctgctggacccgctgcgttttggtgtggcgggcggcaatctcaacagcactatccggctggagggcgatcgctcgccgatgcgtggtcgggttgatcttcatgtccgtaagctgcagctgcgtcagctcttcccgaatgtggaggcgatgaagaacagccgtggccagctcaatggcgatgccagctttaccggcaccggtaactccgtagccgatctgctggcgaccagcaacgggcaacttaagctgctgatgaatgatggtctgattagccgcagcctgatggaaattgccggactcaacgtcggtaactacgtggtgggcaaactgtttggcgatgaccaggtgcgtatcaactgcgccgccaccgatctcaaactgcagaacggtgtggcgacgcctaacctgtttgtgtttgataccgagaacgcgattatcaacgtgtcaggcaacgcgaacttcgccagtgagcggctggatctgtcggtgaatccggagagtaagggcgtccgcatcgtaacgctgcgctccccgctctacgtgcgtggcacctttaaaaatcctgatgcgggcgtgaaaacggggccactgctggcacgtggtgctgctgcagtggcactgggcgcagtagtcggcccggcggcggcgctgctggcactgatctctcctagtgataacgaagacaaccagtgcagcaccgtcctgcagcagatgaagcagaagaagtaactagttgcgatagagtactttgataatgtgataaccaaagccggtctttaccggcccgtaaggcgtcagcagcgggcaggtaaagaccgctttatcaaaggccggcaccatctgtccctgccggaaactcgcccagatcgccgccattccggccggaaggacaggttgagtgcttctttgccagcagctggaaattgccacccttcgccagttttgccagtatctcttttgccagcgcttcctctttgacgaggatgtgtaaagccgccgcggttttcgccatgttggtatctcggttgtgtataattgccgcccagtataaacccctttcttttgattcaatcaggcgatttctcctatgcgtttaaaccccagccaacaacgtgccgtcgaatttgttaccggtccctgtctggtgctggcgggcgcgggatcgggcaaaacccgcgtgattaccaataaaatcgcccatctgatccgtgaatgcggctatcaggcgcgccacatcgccgcagtgacctttaccaataaagcctcgcgcgaaatgaaagagcgtgtggcgcagacgctgggccgcaaagaggcgcgcggtctgctcatctccaccttccatacgctggggctggagatcatcaaacgcgaaaccgcggcgctgggcatgaagtcaaacttctcgctgttcgacgatcaggatcagctcgccctgctgaaagagctgacaaaagagtggctggaagaggataagacgctgctacagcagctcatctccaccatctcgaactggaaaaatgatctgatcgatccgcagggcgccgccgcgctggcgcgatcacagcaggataatatttttgctcactgctacgccctctacagccagcatcttaagtcgtgcaacgtgctcgatttcgacgatttgattctgctgccgacgctgctgctgcagcgtaatcaggaggtgcgtgaacgctggcagcagcgtatccgctatctgctggtggatgagtatcaggataccaacaccagccagtatgaactggttaagctgctggtgggggcgcgggcgcgcttcacggtggtgggcgatgatgatcagtctatctactcctggcgcggcgcacgcccgcagaatctggtgctgctgaatcaggatttcccggcgctggaggtggtgaagctggagcagaactaccgctcttcgcagcgcatactgaaagcggcaaatatcctgattgccaataacccgcacgtctttgagaagcggctcttttcggagctcgggcagggcagcgagctgaaggtgcttactgccaacagcgaagagcatgaagcggagcgggtcactggcgagctcatcgcgcatcactttatcaaccggacgcagtacaaagattacgcgattctttatcgtggcaaccatcagtcccggacctttgaaaagtttctgatgcagaaccgcatcccttatcgcatctctggcggtacttcgttcttctcacggcccgagatcaaagatctgctcgcctatctgcgcgtgctgaccaatcctgaggatgacagcgcgtttctgcgcatcgtcaatacgccgcgccgtgagattggcccggctacgctgcagaagctcggtgagtgggccaacctgcgcagcaagagcctgtttaacgccagttttgatgtcggtctggggcagacgctgagtggccgtggtctggagcatctgcagcgcttcacccactggctgaatgagattatccagctgaccgaacgtgagccggtgaacgcagtgcgtgatttgattcgcggcatcgactacgaaagctggctgttcgaaacctccggcagcccgaaagccgcagagatgcggatgaagaacgtcaacacgctgtttcagtggatgacagaaatgctggagggcagcgatattgatgagccgatgacgctggcgcaggtggtgacgcgctttaccctgcgcgacatgatggagcgcggtgaaagcgatgaagagctggatcaggtgcagctgatgacgctgcacgcctccaaagggctggagttcccctatgtattcctggtgggcatggaggaggggctgttaccgcatcagagcagcatcgatgagaataatatcgaagaggagcgtcgcctggcctatgtggggatcacacgggcgcagaaagagctgacctttaccctgtgccgcgaaacgccggcaatatggcgaattaatccggccggagccgagccgttttctgctggaactgccgcaggacgatctgcaatgggagaccgagcgcaaagtggtcagtgcggaggagcggatgaaaaccggtcagagccgggtggccggtctgagagcgatgctggataaggcgaaaaagagttaaaccagtgcaggaggcgaaagagattcgcctcacgctacggcaattacgacagggttaataaccagtggacgtaagactgataatggctttcctgctccagcagctcactgcgcaacggatgggcctccagccagcccgcgggcagggtcagatgcagggcatcatcgtctgcctgtagccgcaccgcaggcagggtgtcatcgcgacggcgggtggagaaaataatcgccagccgcagcagacggcacatccgttctgccagccgcggcggcagggcgttctgctgcgtcagcaaagccagatcgatgctgccgctctggttttgcagtaaacaggccagcagcttcttctgcgccggtgtgaaaccaggaagatcgaggtgacgcaccagatacgccgcatgctgcggcgcatgacggaagtcaacgctcaggccgatttcgtggatcgcgcaggcgctgagcagcaactcacgacagcgctgatccagcttccacaacgtggaaacctgacggaaaaagctctccgccagctgacgcacgcgatccgcctgctcgacatcaatgctgaaacggcgctggacgttgtgtagcgtgcgggttcggatatcccggtcgatgggcagatgcagcatgccgtagaccagtccttcgcgcagtgcgccgcccgccagcgtcatgctatcgatactgagctcctggaagatggcgatcagaatcgacaggccgctggggaacaccagcgcccgctccagcgtcagcccttcgatttccagctcttccagtttgccgcactgaatggcgcgctgcttcagctgctgtagcttattcagcgtgatgcgctcatccatgccctgcgccaccatgatctcctgcagcgcctgaaccgtgccagaggcaccaacacaggcctgccagccctgctcacgcagttgcgctgcaatgggctggatcatttcacgcgccgccagctcggcctggtcaaagttctcttttgccagatgacgatcgctgaagaagcgctccagccacgtcacacagcccatcgacagactgaacaacaccgacgcatgcgatccgtcgccagtggccagctcggtgctgccgccgccgatatcgaccactaaacgctggtcggaaccgccggtggtgtgggccacgccctgataaatcaggcgcgcctcttcttcaccgctgatgacgttgatggtacagccaaggatctgttgggcggtgtcgaggaaggtctgcgcattggcagccagacgcagcgtggcggtcgccaccacgcgaatttgatcggggggaatatcctgcagttgttcagagaacagtctgaggcagtgccagccccgcgacatcgcgtcggctgacaacaggttatttttatccagaccggcagcaaggcgaaccttgcgcttaatttttgcaacggtctggatactgccagagacctcgcgcaccaccaacatatgaaagctgttagaccctaaatcaatcgctgcataaagtgacgatgcgcttagcatggtggccttaacctgaacgtttacggttgttgttgcgtggagcaccgcgacgattggcgttattccctccgcgacgtgggccattgccggaacggctgcgttgcagacgcttaggcggcggtaaatccgttaacaacgcttcgctgctgtacttgctgaccgggatgctgtggccgatgtactcttcaatcgaaggcagattcagcgcgtattcttcacaggccaggctgattgaatgaccgctggcgcctgcacgaccggtacggccaatacggtgaacgtaatcttcacagtcatctggcagatcgtagttaaagacgtgggtaacagccgggatgtgcagaccgcgagcagccacgtcagtggcgaccagaatatccacatcacctttggtgaagtcatccagaatgcgcaggcgcttcttctgagcaacgtcgccggtcagcaggccgacacgatgtccatcggcagccaggtggccccagatatcttcacagcggtgcttggtgttggcgaaaataatggcgcgatcgggccactcttcttccagcagggtctgcaacaggcgcattttctcttcgttagacggatagaaaagctcttcctgaatgcgatggccggttttctgttccggttccacttccacatattcagcactgttcatgtgctcaaacgccagttcacggacgcggtaagagagggtcgccgagaacagcatgctcagacgctgagtcgccggcggcatgcgacggaacagccagcgaatatctttaataaagccgagatcgaacatacgatcggcttcgtccagcaccatgacctgaatagcaccgaggttgacgtgattctgtttcgcgtagtcgatcaggcgaccggtggtagccaccagaatatcaacgccctgctccagcactttaagctgtttgtcataaccgtctccgccataggcgagacccagtttcaggccggttgaggcggtaaggggttctgcatctgcatgaatctgcacagcaagttcacgcgtcggcgcaagaattaatgcccgtggctggttaacctgacgaccttccgccgcaggatgagagagaagatgatgaaacgttgacgtcagaaacgccatcgttttgccggtaccggtttgcgcctggcctgcaacatcacgccctgaaagcgtaaaaggcagagctaacgcctgaatcggcgtgcagtattgaaagcctttagtatcaagggcttccaccacttttgggtgcagggcgaagtcggaaaacttctgttcagttaagtgtgttttgctcatagtgtggtagaatatcagcttactatcgctttacgaaagcgtatccgatgaaataaagtcaaccaacattggtatattttacgccaattcgccaggcataatcttgtggagtaaaacatgagcagcgataaaatcgttcatctgactgatgacagtttcgacaccgacgtgctgaaagccgacggcgttacactggtagatttctgggctgaatggtgcggtccttgcaaaatgatcgcgccaatccttgatgaagttgcagaagagtatgatggcaagctgaccatcgctaagctgaatattgatgataacccaggcacggcaccgaagtatggcattcgtggtatcccgacgctgctgctgtttaaaaatggcgaagtcgccgcgaccaaagtgggcgcgctgtctaaaggccagctgaaagagtttcctgaacgccaatctggcgtaattcagggctgaatgtccggcagtggtgaatttatctcctgctgctggacgttcgctttcaggcgtgctaatttaccagcactgcattacgaacttaccttgtagttagcatctaaaagttttcccttgttgaaccctgtcgccctgtaccttataaagatagaacggttcagcaatcttacggttagctccaactctggcatcacattcggacatctccctgcataccgatcgccattccatacgatgatcgtcaggaagagccgaaaagagccattaacggcatggattagttgccataccattcacgacaaacattccgagtattaccccgagtttaagaacccatcactatgaatcttaccgaattaaagaatacgccggttgctgagctggttactctcggcgaaaatatgggactggaaaaccaggctcgtatgcgcaagcaggacattatcttttcaatcctgaagcagcacgcgaaaagcggcgaagacatcttcggtgatggcgtgctggagatccttcaggatggatttggattcctccgttccggagacagctcctacctcgccggccctgatgatatctacgtttcccctagtcaaatccgccgcttcaacctccgcactggtgacaccatctctggcaaaatccgtccaccgaaagagggtgaacgttattttgcgctgctgaaagttaacgaagttaactacgacaagccggaaaatgcgcgtaataagattctgttcgaaaacctcacgccgctgcacgcaaataaacgtctgcgtatggagcggggtaatggctcaacggaagatttaaccgctcgcgtactggatctggcatcgccaattggtcgtggccagcgtggtctgattgttgcgccaccgaaagccggtaaaaccatgctgctgcagaacatcgcgcagagcctggcgcacaactatccggactgtaccctgatggtactgctgatcgatgagcgcccggaagaagtcaccgagatgcagcgtctggtgaaaggtgaagttatcgcctcaaccttcgatgagccagcttcacgccacgttcaggttgctgaaatggtgatcgagaaggccaagcgtctggttgagcacaaaaaagatgtcatcatcctgctcgactccattacacgtctggcacgtgcttacaacaccgtggttcctgcttcaggtaaagtcctgaccggtggtgtggatgccaacgccctgcatcgtccaaagcgtttctttggtgctgcacgtaacgtggaagagggcggtagcctgaccatcatcgcgaccgcgctggttgataccggttcgaagatggatgaagtgatttacgaagagtttaaaggtaccggtaacatggaactgcatctcgcccgtaaaatcgctgaaaaacgcgtcttcccggcgattgattacaaccgctctggtacgcgtaaagaagagctgctcacctctcaggaagagctgcagaagatgtggatcctgcgtaagattattcacccgatgggcgaaatcgacgcaatggaattcctcatcaacaagctggcgatgaccaaaactaatgatgaattcttcgatatgatgaagcgtttcttaatccgatactgcctggccgaaccacagattcggcttttttagtccagatgcgcagaaaatcgacctcacgccacgtctcaacgtggcgtttttcatttgtgagctataggattgaacactggcaggagcatttataatgactgtggtagcgatggcgaacttttgaccgttcgtctgtctctttatgcagaattcggaatccgacacagcgataggcgcgttttttcgcgtattgttgtgcgggatgttagctgagagcgtttaacgtgaatttactcactatgagtactgagcttggtttaatttttctcttttccctggctttcctcttttttgctcgaaaagcagctaaaaaaattggtttagttgataagcctaactcacgtaaacgccatcatggcgcgattccgttggtgggcggcatttctgtgttcgcaggtatctgctttacgtttgccattaccaactactatctgcctcacgcgctgctctatctgggctgcgccggtgttctggtgctggttggcgcactggatgaccgtttcgatatcagcgtcaagatccgcgcggtggtgcaggccattgtcgcgctggtgatgatgtttggcgcaaaactctatctgcttagcctgggctttatcgtcggcccgttcgagcttatcgtggggcccttcggctatgtgctgacgctgtttgccgtctgggccgcgatcaacgcctttaatatggtggatgggatcgacggtctgctgggcgggctctcctcggtcacttttgccgccatggggatcatcctctacttcgacggccagaccagcctcgcgatgtggtgttttgcgatgattgccgccacgctgccctatatcctgcttaacctcggcttccttggccgtcgcttcaaagtctttatgggcgatgccggcagcaccatgatcgggttcaccattatctggattctgctggaaacgacgcagggtctgagccatcccatcacgcccgttaccgcactgtggcttattgccattcctctgatggatatggtggcgattatgtatcgtcgcctgcgtaaaggcatgagtccattctcggctgaccgtcagcacatccatcatctgattatgcgtgccggctttacctcccgtcaggcctttgtactgattaccgttgcggcggccattctcgccggtatcggtgtgctgggtgaatatctggcatttatcccggagtgggtgatgctgctgctattcctgggcgcgtttatggtttacggctactgcctcaaacatgcatggcgcgtggcgcgacgtgtccgccgcattaagcgccgtctgagccatcatcgcgaagcaaaaaacaaattaccctgaaaagagctgataaaggatacctctgccatgccttctgacgttgtggacaacgaactggatattcgcagcttttgctgccgtttatggcgtggcaagcgctggattatcgggctggcgctgctgtttgctctggtcgcctggctggccacgctgctgctgaaacaggtctggagcaccacggcgatcaccgatcgtccgacggtgaacatgctgggttcttactatgcacagcagcaatttctgaccaatctggatgtgcgcaacaacgccttaaccctggccgcaccttcacctacggtgatggatcaggtttatcaggagttcaccatgcaactcgcctcctgggatacgcgtcgtgagttctggcagcaaacggattattacaagagtcgtaaaaccggcaatgcgcataatgatgccgcgctgctcgacgatatgatcggcaatatcctgttcacgcccgctgacgcggcacataacctgcccgataacgtcaaactgaaagcggaaaccgctggcgacgccaataatctgctgcgtcagtacatcgcctatgccagtgagcgcgccgcgcgtcatctgaatgacgagctaaaaggtgcctggcgggcgcgtaccgaccagttgcaggcgcaggtgaaacgtcaggaagatgtggctaatgcggtgtttcagcgccagcagcatcggctggagcaggcgctgaagatcgccagccagcagggcatcaatgagaaacagacgcgtgaagcgggtgaaaatctggcagacagcgacctgttcctgctgggccagcccgttttacagggacagctggatacgctgcgcgctaccggtccggagtttgatatcagctatgatcagaacagagcaatgctgaccacgctgcagaccgggccaaaactgaacagccagttccagacctaccgttatctgcgtacgccggaagagccggtatcacgtgacagtccgcgacgtctgttcatgatgattatgtggggtgccattggggcattaacaggcgcgggagtggcgctggcacgtcgtccgcgtctgatgtcagacacgcatgagtgagagaaacagtgtgaaagttctgacggtatttggtactcgtcccgaagcgatcaaaatggcaccgctggttcaggcgctggcgcaggatcccgctttcgaatcgcgactgtgcgtcaccgcacagcatcgtgaaatgctcgatcaggtgctgcgcctgttcaagctgcagccggactatgatctcaatattatgcgccccgagcaggggctgaccgagatcacctgccgcattttagagggcatgaaaaccgtcctgctcgacttcaaaccggacatcgtgctggtgcatggtgacaccaccaccacactggcggcgagcctggcggcattttatcatcagattccggtcgggcatgtggaggccggtctgcgtaccggcgatctcgcctcgccatggccggaagagggtaaccgtaaacttaccggtcatcttgcccatctgcacttcacccccacctcccgatcgcgtcagaatctgttgcaggaaaatctgcccgatgcgcgcattatcgtgaccggcaatacggtcattgatgcgctgctgtgggtccgcgacagggtgctggatgacagcaatctgaatgcacaactggcggcgcgctatccgtttctcgacccggataagaaactggtgctggtcaccggacatcgtcgcgaaagctttggtggcggctttgaacgtatctgcagcgcgctggcgcagattgcccgccagcatcccgaggcgcagattgtctatccggtgcaccttaatcccaatgtcagcgagccggtaaaccggattctcagcggcattgagaatatcattctgattgaaccacaggagtatctgccttttgtctggctgatgaaccgcgcctggctcatcctcactgactccggtggcattcaggaggaagcgccttcgctgggtaaaccggtgctggtgatgcgtgacaccaccgagcggccggaagcggtcgacgccggcaccgtcaaactggtggggaccgatatcgcccgaatcgtggcggaggtcagcagcttgctgactgacgacgctgcctggcaggcgatgagccacgcccataatccgtatggcgatggcaaagcctgtggtcgtattttacaagccttaaaagataaccgagccgaattatgagttttgaaaccatctccgtgattggactgggatacattgggctgccgacggcagccgtttttgcctcaaagggaaaaaaagtggtgggcgtggatatcaacgcgcgcgccgttgaaaccatcaatcgtggcgcgatccatatcgtggaacccgatttagatcaggtggtgcatgcggccgttacgcgtggcgatctgcgcgccaccacgcagccggaagccgccgacgcttttcttatcgccgtaccgaccccttttaaagatgagcatcagcccgatctgcgctttgtgaaagccgcggcggagtcgattgcgccggtactgaaaaagggcgacctggtgattctggagtcgacctcaccggtgggcagcaccgaaacagatggccgactggctggcggcggcgcgtcccgacctgcgctttcctcagcacggtgatacgcccgatatttttgtggcctactgtccggagcgcgtgctgcctggtcaggtgatggttgagctgattaacaacgaccgggtgattggcggcatgacgccagcctgttccgcccgcgccagcgagctttatcggctgtttttaaaaggcgaatgcgttgaaaccaacgcccgaaccgccgagatgtgtaagctgacagaaaacagcttccgtgacgtgaatatcgcctttgccaatgagctgtcgctgatttgtgccgatcaggggattaacgtctgggagctgattgcgctggcgaatcgccatccgcgcgtcaacattctgcagccgggcccaggcgtcggcggtcactgtatcgccgtcgatccctggttcatcgtggcgcagaatcctgaattagcccgcctgatccgcaccgcgcgcgaggtcaatgacgccaagcctcagtgggtgctggaccaggtgaaaaccgcgctggcggactgcctgacacagaccggcaagcgcgccagcgatatcaccatcgcctgctttggcctggcctttaaacccaatattgacgacctgcgcgaaagcccggcggtgggcgtggcacagaaaattgcagagtggcacagcggcactacctgggtggttgaaccccatattgagcagcttgctgacgcactggccgacaaagccgtgctggtctctgccgggcaggcgctggaacaggccgatattctggtgatgctggtcgatcaccgcgccttccgcgccattgatggtgccagcgttcagcagaactggattgtcgacaccaaaggtgtgtggcgatgaggcgttttctgatcacgggcggtgccgggtttatcggttctgcactggtgcgctttaccgtataaacggcttacatgtgtgggtgcctggcgtaacagctggctgagtgatgaccagctgcgggccgcgggtgaagcgctgacaaaaaccggctacggccaatacctgctggatttattacatgcccgtccacgtcaatattaatccccttagctgggagagcgcattcttcggtgttgataccgtgcggctggagccgcaaggtgacattccgctggaacaggcgctgcgtcatccctgtgcgctgatgcagataaaagtcgctgccagcgagacggcgctgattgatacgctgcagcagcatcagttccggctggcagaaggcgaagcagatctgacgctggcgctgaaacagactgaacggcaggcgggaattcgcattgcgcgcgaagcccagatcccgctactgcgcgatgctgcctcacagctcttcagccagagtcgttttcgcgcgccctggtatgcgccggacgccagcggacgcttctatgcgcagtggattgaaaatgcggtacgcggggcgtttgacgatcagtgtctggtggcaagcgatgccgcgggtcagctgcagggatttgtttcgctgcgcgcggtggatggcgatgcccgcattggcctgctgggcgtactgcccgacgcgcagggccaggggctgggtcagcgactgatgctggcggcggcagactgggcgcgggtacgacagctggctcagcttcgggttgctacccagctcagcaatctcacggcgatgcgcctctatttacgcagcggtgcccggctcgacagcaccgcgtactggttttacaggaaaggtcatgattccatttaatgcgcccccgattgtgggcacagaaattgagtatatgcagtcggcgatgaacagcggcaagctgtgcggcgatggtggatttacccgtcgctgtcagcagtggatggagcagcgttttggcagcaaaaaagtgctgctgaccccctcctgtaccgcttcgctggagatggcggcgctgttaatcgatctgcagcccggcgatgaagtgattatgccgagctacacctttgtctctaccgccaacgcctttgtgctgcgcggcgcccgcattgtgtttgtcgatgtgcgcccggacaccatgaacattgatgaaacgctgatcgaagcggccatcactgaaaaaacccgcgccattgtgccggtgcattacgcaggcgtggcctgtgaaatggacaccattatggcgctggcggcaaagcataagctgtttgtgattgaagatgcggcgcagggcgtgatgtcacgctacaaaggtcgtgcgctcggcaccatcggtcatattggctgcttcagtttccacgaaaccaagaactacaccgccggcggcgaaggtggcgcgacgctcattaacgacgccagcctggtcgagcgcgccgagatcgtgcgggaaaaaggcaccaaccgcagccagtttcttccggggtcaggtcgataaatacacctggcgcgatatgggatcgagctatctgatggccgatctgcaggcagcctatctctgggcgcagctggaagccgctgaaggtatcaaccagcagcggttacgcatctggcagcgttattacgatgcgctgcagccgctggcggctcagggacgcatcagcctgccggtgatccccgccagctgtgaacacaatgcgcacatgttctacatcaaactgcgcgatcaggacgatcgtcaggcgctgataaactggatgaaagaagccgagatactgacggtgtttcactatattccgctgcacagttcgcccgccggtgagcggttctcgcagtttgtcggggacgatcgctttaccacgcgggaaagtgaacgcctgctgcgtctgccgctgttttataacctgtcggataacaatcagagcacggttatcagctcactgctgagcttcttttcctgatgtcattagccagagcctcagtgtggaccgcatcgtccacgctggtaaaaattgtggccggcctgctggtcgtcaaactgctggcggtcagcttcggacccgagggtgtcggccaggcggggaacttccgtcagttgatcaccgtgctgggcgtgctggcgggcgcaggcatctttaatggcgttaccacctatgtggcgcagtatcagcagcagcccgaacagttgcgggcgatggtgggcacggcatcaaccatggtgctgggcttttccggtgtgctggcgctgctgtttctgctggcggcggcacccatcagtatcgcgctgtttggtcacgaccgctatcagggcgtcatccgcgtggtggcctttcttcagctcggcatcgcctgggccaactttaccctggcgctgctgaagggctatcgcgacgcgcgcggtaatgcgctggcgctgattctcggcagcctgattggcgtggcaggctatctgctctgctggtggctgggcggctatcagggcgcgctgacgggtctggcgctggtgccggctttgctgctgctgcctgcgctgatgatgctgaaacgccgcgcgccgctgccgcttagctggctgcgaccgcaatggcatcctgagctggcccgtaatctggcaaaatatacgctgatggcgctgatcaccgccgtgaccctgccggtcgcctgggtgttgatgcgtaatctgctggcggagcagcagggctgggcacaggtcggattgtggcagggcgttaccagcatttccgatgcctatctgcagtttattaccgcgacgtttagcgtctggctgctgccgacgctggcgcggctggataacaaacgcgacatcgcgcgcgagattggccgtgcactgcgctttgtcctgcccgccgtagcggttgccagcctgggtgtctgggtactgcgcgatttcgccatcagcctgctgttctctgaagcgtttcgcgggatgcgcgatctctttgtctggcagctgtgcggcgatgtttttaaggtcggcgcctatgttttcggatatctggttatcgccaaagcctcgctgcgcttttatgttctgactgagatcagccagttcctgttgctgaccctgttttcacgctggttgatcccgttacatggcgcgacgggtgcggcgcaggcctatatgtttacctatatggcttactttgccctgtgttgtggcgcttttattgtttactgccggaaaaaatgactttaattcacgttttgggatcggacattccccaccacaatcttacggtgctgcgctttttcaacgacgtactcagcgttgagcagcctgcggctgcgccacgccattttatggtggtgacgcagcagcccgagaacctggcgccgttcagtgcgttgcagatcgagtgctttaccagcaagaaagcgctggcgcaggcggtactgcagcgcgccagaaatcgtcagcagcgttttttctgccacggacagtttaacccgtggatctggctggcgttactcagcggtaagctgcgtcgttcacagctcttctggcacgtctggggtgccgatctttatgaagattcgcgcagcctgaagttccgtctgttctatctggtccgccggatagcgcaggggcgtgttgcacaggtttttgcgacccgtggcgatctgcatcactatcagcagcgccatcggcgcgtacccggttcactgctctattttcccaccagaatgcccgccgcagccgttgaatctgtcccgtcggagccttttacgctgttgctgggcaactcgggcgatccgagtaaccggcatatcgaaggtttaaaagcgattcacgcgcagtttggcgagcaggtgcgtatcgaggtccctttgggctatccgccaggtaatgaggcttatatcagccagattcaggcagctgccgatgcgctgttcccgaacaggcaggtgaatctgatgcgtgaaaacctggcgtttgatgattacttagccctgctggcgcgctgccatgtcggctattttatgtttgaacgtcagcaaggggtgggaacactctgcctgctgattcaggccaacgtgccgtttgtcctgacccgcaaaaatccattctggcgtgatgtggcagagcagcagcttccggtattgttcagcgaagatacgctgtcgcctgcggtgatcgccgaggcacgtcgtcagctgatgagctgtgataaacaggctatcgcctttttttcgccgggttatctggcgggctggcgagccgcgttacagctcagcgaaggggagttgtcatgagtcttatgcagtttggcggcctgctggtggtctatctgctgtcgctggtttttattctgaccctgacctggcgggagtttaagcgcgtccgttttaactttcatctgttcttcacgctgctgttcttactgaccttttacttcggcttcccgctgacctccgtgctggtgtttcgctttaatgttgaagtggtgccggttgagaacctgctggaggcgctgctgtcggccacggcgttttacgccatttattacgtcagctataaagtgcggctgaaacccgccagcgcgtctccggcgaagccctggctgcagatgaatcgcgtcgaaacccatctgacctgcgtgatactggcgctggtggcgctgggtaccgtgacggtgttcttcattcataacggttttctgctgttccgcctgaccgcctataaccagattttctccagtgaagtgtcgggtgtagcgcttaagcgcttcttctatttctttattccggcgatgctgatcccctactttttgagcccgacgcgccgcaactggctgctgttcctggtggtgaccgttgcctttggtttactgacctacgcgctggtgggtggtacccgcgccaatatcattattgcgtttgccctgttcctgtttatcgggattacccgtggctggatcactttgtggatgctggcaacggcgggcgtgctggcgattgcaggaatgttctggctggcactgcgccgctataacctcgacgttatgggcgatgaagcgttttatactttcctctatctgacgcgtgataccttctcgccgtgggagaatctcgccttgctgctggataactacgccagaattgagtttcaggggctggcaccgctgtggcgtgatttctacgttttcattccgacctggctctggccggatcggccgctggcagtgttaaacagtgctaactacttcacctgggaagtgctgaacaaccattctggcctggcgatttcacccacgctgatagggtcgctggtggtgatgggcggcgtctgggcgattccgatcggtgcggtcgcggtagggatgattataaaagcctttgatgcaatctatcagcgtggctgtcttgagaccaaccgttacaccggcgccatcctgcaaagcttctgttttggcgcggtctttaacatgatcgtgctggcacgcgaaggccttgatgcgtttcggttcacgcgtggtgtttttctgcatcatttttgctgcctgtctgggcatggctaaattacttttctggttactggatcgcgcaggtttgattcgcgaccgcagcaggcgggtgttgcacagcccgctctgagtagcctctgggattgacggaagatatgacaaagttaactgagacgccgcagtaccggatccgtggcgttgagttgtatggcttcgaaaacatgccgtcggcggtgaattttctgatgccgccgcagagcgtacgcagcggtattttagtggcgattaatgcggagaagatcctgaccgctgagcgggatgagggattacgtacgctgttagcgcaggcggaatatgcatacgccgatggcatcagcattgtgcgctcgattcgtaaaaagtatccacacgcgtcggtgcagcgcattgcgggtgctgatttatgggaagcgctgatggaacgcgccgggcgggaagggacgcctgtatttcttatcggtggtcgtcagcaggtgctggatgaaacctgcgataagctacgtcgtcagtggaatgtgaatattgtcggggcgcaggacggctattttgcgccagccgatcaggatgcgctgtttgcccggattgcggccagcggcgcgaagctggtgactgtagcgctggggtcgccccgtcaggagctattgatgctggcgtgccgtgcgcactggcctgatgcgctctatatgggcgtgggtggaacgtacgatgttttcaccggccatgtgaagcgagcgcctgagatctggcagcggctgggtctggagtggctctatcgtctgattcggcaacctggccgcctgcgccggcaattaaaactgcttaaatatttgcgctatcactggcgtggcgatctctgatattgctgataaatgccgcatttttacgcgttgtgagagaggaaatgcactatttgtcgacaaaatgcacaaagcgtaatcaaacgcgtctttttatttaaaaagcactagacacgatgggcgcttatctctagtatgcacatccgcaacggcgctacgcgcccgtagctcagctggatagagcgctgccctccggaggcagaggtctcaggttcgaatcctgtcgggcgcgccatatcgtttgtgcgcatgagcttcggtggttgatttaccgcggttggcagtagagatttaaatgctgcaggtttttaacttgtgacattaagtattgtggtggctatagctcagttggtagagccctggattgtgattccagttgtcgtgggttcgagtcccattagccaccccagattttgctgggaaacgcgaaggtggcggaattggtagacgcgctagcttcaggtgttagtgtcttaacggacgtgagggttcaagtccctctcttcgcaccaggcaaaacagttaaaaaaatcggcgagtagcgcagcttggtagcgcaactggtttgggaccagtgggtcggaggttcgaatcctctctcgccgaccattttagaaacctgtctgaaaagacaggttttttttcgtctgcagaaaagaggatgagaatttctgcgggagatttgggtagggtgcagaggggcagcgtagctgtaaatccgagcctgcgaaggaaatacggtcagatcggaaaggcgctaatgccatccatggccgctcggcccgcgccgtccctggcgcgggacgctttcctcctctgaccgtattccctgcgcgttgagcttatgcattgcggccagattgactctggcttgggctatcagccgtcttaagcgctaatgtaagtacctgatgcgtgtgccagacgtgaagcgaagggagcatacgcctgtggtcagagcatcgcgccgcccggataaaaacgccgggagcgtttatgaacaacgcaaagcgttggcccggctacgggcgcacctcagggatgaggtgcgtaatcgcccgcgctgagcccgccagggatggcgtcttttgcgtctttgcgaaaggcgtatgctccctgaagcccgcacagcggtgagagcgggcagcgtgtgagcttatccgttgcaaccagagttactatgctttgattccgtttcgcaatataagcaggagcaacagcgtcgtgaattgccgacaaataagtcattgttattgttgagttcacagagagattggctttgctgtctccattcagagacagagaaaatgccagctgtcgctggataccgacatttcccgacaggcctgttgaatgaagctttgagctaattctttaacctgctgatttattgtgattttaaaaataatcataaacctggcacggcttgtgcaatagttcagctgtagatgctcattccacctcttatgtctgctgatgctacataaacctgggaatgatgcagagccaattttaggtacctgttgtctgcctgcctgtatcgcgaaagccttacagggttaacagacaccacgttgagtcaggtacctcccggttgtcttaccgacctgatcttgcacctgccactggcaggtgtttttttttgcctgcgaaagcgtgctggcagattgcgggcacaaaaaagccgggcaagcccggctttatcaggtatgaaaagaggatcaggcgttgggattgttcttcaaggtgagcagcaacccttcacgacgcatcttcgccgcttcttccgggcgacgcagacgatcataaacatccgccagccatgcataatcaaacgcgtcaggacgctgtgccagcgcctgctgcagtgcctcagcagcctgctgccattcaccatgccgcatcagcaactgccccagcgtactgtgcagcagcggtgttgcgccgtgttgtttgatttgctggcgtagaactttctccagcgcttccggattaccgcttttgatacgaggcatcagcagtaccagacgatcgtcataatgacgcttgaggccctccagcacgatcgattgcgcggtgtcgtgatcgttgcattcaatcagatgatccgccatggccacctgcagcgtcgtttcctgacgggttttgcggctcagatcgttccaccagcgcttcagcccatcgctgccctggtcagccatcgcctgattcatcagacccagccaggcttgctgctgtaatgcatcacgatgcagctcatcgccgacctgcgccttctgcatggcgggcagaatatccagcaatgcactccaggcaccagtacggacatacgcctgtttcggccaggcgcagcacttcaggatgacgcggtgccacttccagcagacggtcaatgctatgacgcgcagcatgatcttcgttacgtgccagctgaatacgtgcgcgggcaatttctaccggaatggtgttgctctccgacagctctgcagcacgttcaagatgctgattggcacggatttcatcaccacgctgttgcgcagcttctgctgccagcaggtagttcgccactggcacatcagcgtgatcggcatctttagaaagcagtttttccacctgacggtgatcgccttctgccagcttcatcagtgccgactgagtatgacgctgggcgcgacggcgtttacgtccggtaaaccagccacgggtacgcgcgccggtgtgcagcacgcggcgcagcagccattccacggccagaatcaccagcaggctgaggatgaggataatgaccaggccggtgacgctggtttcgatgttccagttatcggtctgaatcagcacgtaaccctgatgaccggcaatcatcggtcccagcaccacgccagcaatcagcaggataaagaggataaataccttaagcatgcttagcctccctgctgattagcagcggcagaaggttgcgctaacaggttccggacgcgggtctgcatcagctgttccagcaacggctgactttccaggttatccggcaggtccatattgatgttctgctggctcagctcatccagctgggcaaggaaggctttggtagcggcatcattggtgtcgtaccaggcgcgaacccatgcggacacggtgtcgatagattgtttataaatctcatcctgatgacgcggtaccgcctgagcagcaatcagcagacgcgagcggatattctcacgcaggtaaacatcctgattaggtgccagcagcggctgggcggtgttatcgcggcggcggatggtaataaaatcatccataaagttatgccagcttttcaccagattctgacgccattcgcgcacggaacctgacagttcaccgccatcgctgtccatcggcgcatcatcgctgtcattatcggccagacgcagattatcaacgttgttcgacagctggttcagtttgaggatcacgccgtcataatcgacctgcgtaaccgaagagaggttactgatatcctgggtcagcgcacgacgcacattcatgacgctgggatcattcatgtcggccaggctggcatcggcgcttttcagcagtgcagctgcggtggtgacatcctggtcgctccagagtttgcggccagccagtttcaccagatagtccgcctgtgccagcaaccagctgcgcacgtcgttgccagaaatcacggccactttttcacgcagggtttccagctcttttgctgacgcgtttctgctgtgtctgggctgtctgcaacgcggtttcagcgccgctcagttgctgagtcagctgctgtttgtcgctgctggcctgctgttgcaacgcgcttaattgttcgctcagcttctgattggtttgtgcctgtaaatcagcctgatgtttcccgttaaggtataaacccgcaccaatcgccagcgcaatgacaatcgcaactgcacccaacaccatgccaccatttttcgcattacgcggtggtgtgctgttgctggaaggagagcggtcgaccgctggggtggtttcttcaaccatggcggaggagtctttttgttccgtcatatgtggcacatcccattgttaaagttcagcgtaacgcgcgcagcagcgcatcgttatcggcaccatcggctacctgaatatcctgccaacccaatcctgcggccagggtagccaaacgttcactgacgacaaccagtcggcagttgagcagccattcctcgcgatcaactgcggggaacagcgaaaaaagctgttgtaacatttcaccgctggtcaccaccagcacggagacaccgcgatcgcgccagcggcgtccttcaacgggtccatcataatacttctggcagcgctgataacaggctgcaaacgacacctcagcacctcgccgggttaacgtctgagccagcaactcgcgtccgggatcgccacgcaggatcagcgcacgtttaccggcaacctgctgaagggtattcagccggatcaattcttcactggtttcatgcgcatgaggccaggtcacctgctgtccgctggcggtatgaaacgccagtgcggtgctgcgaccaattgcataatagtccagctcagcgggccatgctgtgacggtgtgttgtgcgtaatgtataacctgctgagaaaggataaaaaccaggtcgccagggcgaagtgcggcgagcttttgtggcagagaggtgagatcagcgcccggcgcaaattcgatcagcggcaggctccacgcctgtttgccaagggcatgcaggcgtgacaccagctctgccgctgcgggttccgggcgcgtcaccagaatggtcatgccggcggctgcccctggtaaacttcctgcaggatttcacgcgcgccgccattcagcagttcatcggccagtgaaatacccatctgttcagcctgagcgcggggaccacggcgtttcgccgctgaccatgacccggccatccggtgcgccgaccatgccgcgcagccagaggtcatcgccttccagcaccgcgaaactgccgattggcacctggcagccaccctctaaacgggtattcatggcgcgctccgctcggacacagacttcggtatcatcgtgattcagcgcctgcaacaggccaattaaggtggtgtcgtccagacggcattcaatgccgaccgcaccctgacccacggcgggcagggaaacttcggcaggcatcgcctgacgaatgcgatcttccagtcccaggcgtttcagcccggcgacagcaagaataatcgcgtcatactctccggcatcaagcttgccgaggcgggtgccgacattgcctcgcagcgagcggataaccaggtccggacggcgcgcactaatctggcactgacggcgcaggctggacgtgccgacaatggcaccctgtggcagcgcgtcgatagagtcataatgatgagaaacgaacgcatcgcgcggatcgtcgcgctcgcagatggttaccaggcccagaccttccgggaaattgaccggcacatccttcatcgagtgcaccgccatatcggcacggccatcctgcatcgccagctcaagctctttgacaaacagccctttgccacccacttttgccagcggcgtatcaaggatgatgtcacctttcgtgaccataggcaccagctcaacgcgcagtcccggatgggcactcatgagtcgttgctgtacataatgtgcctgccataatgcgagcgggctttgtcttgtagcaattctgaaaattttgtctaacatgctgttaaccatttttatcgttcactgaatatcctatcatctctgggtgaagactgtcagtttcaacggattgaaaacggcctgcgtgcggtttcaggccggtttattaagccataacgtgggaaccagagctgaaaaggcgggaagctggtaagaacgtgctaaactgtcaggtagcgcaactttctttacggtcaatctgcagggtgttagattgatcacgtttccagcaattatctgcccacttttttactttataagcggcagagtgtggaaacagggtgcttaaacactgggacaatcaggcgaaacgtcttgtacctctacattgagacactgaaacagagactggatgcaatcaaccagctgcgcgttgatcgtgcgctggctgctatgggacccgcttttcagcgcgtctacagtctgctgccaaccttattacattatcaacatccgcagatgccgggttaccttgaaggtagcgttccacatggcatcagcttcttcacgcctgatgaaaatcagcgtcagctgctggccgatctcaccggcgacagcgatctgcgtcatgccgatgcgccgaaaggcgaaatgccgattacggcgatctattctatgggcagcacctcatctgtcggccagaacagcgtctcggatctcgatatctgggtctgccatcaatcctggcttgataatgaagagcgtctgaatctgcagcgcaaatgtacgctgctgcagaagtggtgcgtttcaatgggcgtagaggtgagtttctttctgattgatgagaaccgcttccgccacaacgaaagcggcagtctgggcggtgaagattgcggttcaacacaacacattttactgctggatgagttttaccgtaccgcggtttcgtatggcgggtaaacgcatcctgtggaatatggtgccgggcgaagaagagcacaattacgacgactacgtaatgtcgctctatgccaaaggcgtgctgacccctaatgagtggctcgatcttggcggcctcggcacgctgtcggcggaagagtatttcggcgccagcctgtggcagctttataaaagcatcgactccccgtataaagccgtactgaaaacgctgctgctggaagcctacagctgggaatacccgaatacgcaactgctggcgatggatatcaaacagcgcctgcatgacggtgaaatcatctgcttcgggcttgatccttactgcatgatgctggagcgcgttacgcactatctgaccagcgttgacgatcagccgcgtcttgatctggtgcgtcgctgcttctacctcaaagtgtgtgaaaagctcagcaccgaagatcatcagcatcgcaccggctggcgtcgcgaaattttatcgcagctggtcaaagagtggggctggaacgaagagaagattgccattctggataaccgcgctgagtggaaaatcgagcgggtgcgcgaagcccataatgaattgctggatgcgatgatgcagagttatcgcaacctgatccgctttgcccgccgcaataacttaagcgtcagcgccagcccgcaggatatcggtgtgttgacccgtaaactgtatgctgcgtttgaagcgctgccgggcaaagtgacgctggtgaatccgcagatttcgcccgatctctccgaacccaatctgacctttattcatgtgccgcctggccgcgccaaccgttccggctggtatctctataaccaggcgccggacatggattcgattatcagccatcagccgctggaatataaccgttacctgaacaagctggtggcgtgggcgtggttcaatgggctgctgacccgtaaaacccggctgcatattaaaggcaatgaggtttgcgatctggcgcgtctgcaggagctggttaacgatgtttccagccacttcccgctgcgtctgccttcgccgacgccaaaagcgctctacagtccgtgcgaaatccggcaccttgcgattattgttaaccttgaacacgatccgacggcggccttccgcaatcaggtggtgcacttcgacttccgtaagctggatgtctttagttttggtcagcaacagcagtgcctgattggcagcatcgatctgctttatcgcaactcctggaatgaggtgcgtacgctgcacttcagcggcgaacaggcgatgatcgaagggctgaaaaccattctcggcaagatgcatcaggatgctgcaccgcccgatacggtggaagtgttctgctacagccagcatctgcgcggtctgattcggacgcgggtacagcaactggtctcagaatgcattgagcttcgcctctccagcacacgtcaggagccgggtcgctttaaagcgctgcgtatggcgggcgagacctggggcctgttctttgaacgcatgagcgtttcagtgcagaagctggaaaacgcggttgagttttatggcgcgatctccaacaacaagctgcacggactgtcgatcaaagtcgaaacgaatcagacgccgctgccacccgtggtcaacggttatgccagcgaaggcattattcagttcttctttgaaaacaccactgatgagcgcggcttcaatatctacatccttgatgagaccaatcgggttgaggtctatcatcactgtgaaggcagcaaagaggagctggtgcgcgatgtcagccggttctactcctcatcgcacgatcgctttacctatggttcgagctttatcaacttcaacctgccgcagttctaccagattgtgaacaccggtgagcgattccaggtgattccgttccgtagccagacgctgacgcagctgtgtacctcgcagcctgacaacgacaacagcgactatcagccacgctatcaggtgcactgatgctgacgggctgcctgcgctctgcaggtggccgctatcttcccggcttgtcacccgcttcacgctatttgcgggcatttcctgttgcttttccaccttcaactgcgatgataagcatccaggtaaaggacatgaagagcataaagaatgaagaaagtaataagcctgttggccatgacactggcagtaatcagccttgcaggttgtggtctgaaaggaccgctctacttcccgccgaaggatcagccgaagaaacaacaagccccaaccgaccgccagaaagcggatgcctctaaagccgatgtcggcgggctggttaccggcaattcaggcgtaaaagcgaactaatctgatggcttatccggcggagcaaaaaatgcagttctccaaaatgcacggtctcggcaacgattttatggttgtggatgcggtgacacaaaacgtcttcttttcgccggaattgatccgccggctggccgatcgtcatctggggatcggttttgatcaactgctgattgttgaaccgccttacgatcccgatctcgatttccactatcgcattttcaacgccgacggcagtgaagtcgcacagtgcggcaacggtgcgcgctgctttgcccgctttgttcagctgaaagggctgaccaacaaaagtgacatccgggtcagtacgcagaatggccgcatggtgttgaccgtcacgcctgacgaccaggtgcgcgtgaacatgggcgagccaaactttgagcctcagcaggtgccgttccgcgccaacaaggccgaaaatctctatctgctgcgcgtggccgaacagacggtgatgctgggtgcggtgtcgatgggcaacccgcactgcgttatccaggtcgaaagtgtcaaaaccgcgcaggttgaactgctgggtccgattctggagagtcatgaacgcttcccggatcgcgtcaatgtcggttttatggagatcatcaatcccgaacatatccgcctgcgcgtctacgaacgcggagcgggtgaaacgcaggcgtgcggcagcggcgcctgtgctgccgttgcatgtggcattcagcagggcattctggcacccaaagtccgtgtcgacctgcctggcggaacgctgcacatcacctggaaaggcgccggtcagccgctctatatgaccgggcctgcgacacacgtctacgatgggtttattcatctatgaaaaatatcgaagagcaggctgacagttcggttctgctggacgatcaggccgtcagtgattatctgcggcagaatcccgatttctttatccgcaatgcccgtgcagttgaacagatggccgtgccgcatccggtgcgtggcagcgtctctctggtcgaatggcatatggcgcggcaacgcaaccatattcagcggctggaagaagagatcacgctgctgatggagcaggccagcgctaaccacgaactgtttgatcgtctgctgtcgctggagagccatctggccgcggctgactcgctgcaggatatgctcaaccgcctgcatcgctgggcgcgtgagctgggcctggcgggtgccaatgtgcggctgttcagtgataaatggctgctgggcgcgccctccgatttctttcagctgagcctctcgcgtcaggcgtttgaaccgctgcgtatccagcgcttcggtaaccagcatcactatcttggcaacattaacgggccggaactgctgctgctgctgccgcaggccaaagcgatcgggtcggttgccatgtcgctaatgggtgaggagggcgatctcggcgtgctggtgttcagcagtcgtgacagccagcactatcaatcgggcatggggacactgctgttgcagcatctgtcgcagatgatgcctgatctgctctcccgctgggttgaacgcgcatgagcagcgcgctgcaggaggccgtcgacggatttctgcgctacctgaaagtggagcgccagctcagtccgttaacccagagcagctatgcgcgccagcttgccgcgctggtggcgattgctgatgagatgaagctcagcagctgggcgcagctggaaccggcgcaggtgcgcagcatggcggcgcgcagccggcgcgccggactggccgccagcagcctcgcgctgcggctctccgccctgcgcagttttctcgactggcaggtgagccagggtttgctttctgccaacccggccaaaggggtgatgacgccgcgtaaagcgcgccatctgcctaaaaacattgatgttgatgaagtaaaccagctgctggagatcgaccttagcgatccgctggcggtgcgcgaccgggcgatgctggaagtgatgtatggcggcggtttgcgtctctctgaactggtgaatatggattgtcgccacgtcgatctcgattcaggcgaagtgtgggtagtcggtaagggcagcaaagagcgccggataccgattggtcgcacggcggtcgcctggatccagcactggctgccgctgcgtgaaacctttggcggccaggatgatgcgctgtttctttcgacgcgcggcaaccgcatctcgccacgcaacgtgcagaaacgctttgccgaatggggcatccgacagggcgtggccagccatatccatccgcataagctacgacactcatttgccacgcatctgctggaatccagtggtgacctgcgcgccgtgcaggagttgctgggccatgcaaacctgtcgacgacccagatctatacccatctcgatttccagcatctggcttcggtgtatgacgctgcgcatccccgcgccaaacgaggaaagaacgaatgaaattttatcgtccgctgtcggccataaaagccatgaccttcgaccttgatgacacactctacgataactacccggtcatccgtcgtaccaccctggagtcccatgccgcgttacaggcttttcatccggcgctgcgtgacttcacgccgcaggattatcagcagttgcgcgatgagctgctgcagcgcgaacctgatatctatcatgatgtttcggagtggcgacgccgttcggttgagctggcgatgctgaatatcggcctctctgccgctgaagcctccgcgggtgcggcagaagtgatggcggtcttccatcagtggcggagtcaggtcgagatgccggatgagacgcaccagacgctgaaagccctggcggagaaaatcccgctggtggcggtcaccaacggcaacgcctgcccggaaaaaatgggcattgcagaatacttccgcttcacgctgcgggccgggccagacggtcgcgccaagccgtggcaggatatgtatcagcttgcagcgcaacgccttgatatcgcgccacaccatattctgcacgtgggtgatgacctgaccaccgacgtggcgggctcactgcgctgcgggctgcaggcctgctggattaacctgcggcagggcaatctgatgcatatcccggatgcgcgcctgttgccgcatgtcgaaatttcgcggttggcatcactcacctcactgctataatggctgtaaatttatccagtcgtctcctcttttctgttttgccgccgtcccttatccggcgtctgtggcgccgcctgactggcagcgataatgccttacggcaggcggaataatcagtgtgacgacggcgtttttttctttggtaatcggtgcttatggacgtttctgaactgctcgatggtttgaatgacaatcagcgcgctgccgttgcggcaccgcgcagtaacctgctggtgctggcaggcgcgggcagtggtaaaacgcgggtgctggtgcatcgcattgcctggctgatgtcggtggagaactgctcaccctattcgattatggcggtgacctttaccaacaaagcggcagcggagatgcgtcaccgtatcgagcatctgatcggcaccagtcagggcggaatgtggatcggaaccttccacggtctggcgcaccgcttactgcgcgcccaccatcttgacgccggtctgccacaggattttcagatcctcgacagcgaagatcagctacgtctgctcaagcgcctgatcaaatcaatgaaccttgatgacaaacagtggcctgcgcgtcagggcatgtggtacatcaatggcaaaaaagatgaaggcctgcggccaaagcatatcgaaagctacggcaatccgattgagcagacctggctgcgcatctatcaggcctatcaggaagcctgtgatcgcgccggtttagtcgactttgccgagctgttgctgcgcgcccatgaattatggctcaacaagccacacattcttaatcactaccgtgaacgctttaccaacgtgctggtggatgagttccaggataccaacaacattcagtatgcctggattcggatgctggcgggcgacagcggccgggtgatcatcgtgggcgatgatgaccagtcgatctacggctggcgcggcgcacaggtcgagaatattcagcgctttctgcaggatttccccggcgcggaaacgatccgtctggagcagaactaccgctcaaccaataacatcctgaaagccgccaacgccctgatcgctaacaataatggtcgtctggggaaagagctctggaccgaaggcagcgatggcgaaccgatctcgatctactgtgcctttaatgagctggatgaagcacgcttcgtggtcaaccgcatcaaagtctggatggagaaacggcggcgcgctcaacgactgcgccattctctatcgcagcaacgcccagtcgcgtgtgctggaagaggcgctgctgcagagcagcatgccgtaccgtatttatggcggcatgcgcttcttcgaacgtcaggagatcaaagatgcgctctcctatctgcgtctgatggcgaaccgcaatgacgacgcggcatttgaacgcgtggtgaataccccgacgcgcggcgtgggcgatcgcacgctcgacgtggtgcgtcagacggcccgtgaacgtcagatgacgctgtggcaggcaacgcgtgaactgctgcaaagccgtgcgctggctggccgggccgcgtctgcgctgcaacgcttctgtgaactggttgattcactggcaaccgaaaccgccgagttaccgctgcatgttcagaccgaccgggtcatcaaagactctggcctgtggctgatgtatgagcaggaaaaaggtgagaagggtcaggcgcgtatcgaaaaccttgaggagctggtgaccgctacgcggcagttcagctatcaaaatgaagatgaagatctgatgccactgcaggcctttttatcccacgccgcgctggaagcgggcgaaggccaggcagacaaatggcaggatgcggttcagctgatgacgctccactcggcaaaagggctggagttcagccaggtgtttattgtcggcatggaagagggcatgttcccgagccagatgtcactggatgaaggtggccggctggaggaggaacgtcgtctggcttatgtcggcgtgacccgtgcgatgctcaagctgacgttgacctacgccgaaacccgccgactctatggtaaggaagtgtatcaccggccgtcccgttttatcggcgaactgcccgaagcgtgcatagaagaagtgcgtctgcgcgccagcgtcagccgtccggtaaaccatcagcggatgggtgccccggtgaccaaaaatgacagtggattcgcgctgggtcagcgtgttcatcacgcaaaatttggcgaaggcaccatcattaatctggaaggcagcggcgagcatagccgtcttcaggtggcgtttcaggggcagggaatcaagtggctggtggcggcttacgcgaagcttgaaacgctttagcgtgcggttgacggctttttcgtctcagcgtaacatgcgcccactattatcatgagaggacaatgccttggacacgcccagtcgatgctggctcaatgacctggattccaggaataacatctaaggctacctctttacgcgggtagccttagcggttatcagcgacctccctttttgattccgtcgcgagtcagcactgatttatctctgaaactctgtttccgtgttcaggctgcccgttccatgttgaggaacggcggactgccttgtcccatttagtctgcaatggggagtattgctatgctgagcgcatttaaactggatcacagccgcctgacgcgactggagctggaagacgaaaacgacaaactgacaacctctgtctgggtcgatctgatcgagccggaagagggcgaacgtgatcgcgtgcaatctgagctaggccagagtctggcaacacggcctgagctggaagatatcgaggcctcggcacgcttcttcgaagatgaagatggtctgcatatccactccttcttcttctatgaagacgctgacgatcacgccggtaactccaccgtggcgtttaccatccgtgaaggccgtctctacacgctgcgcgaacgtgagctgcctgcgttccgtctctatcgcatgcgcgcccgtaatcagaccctgatcgacggcaatgcctttgagctgctgctcgacctgtttgaaaccaaaatcgagcagctggcggacgaaatcgagaacatctacagcgcactggagaaactcagccgggtgatcatggaaggtcagcagggcgaagagtacgatcaggcgctgtcgcgactagcggaactggaagatatcggctggaaggtgcgtctctgtctgatggatacccagcgcgccctgaacttcctggtacgcaaagcacgtttgccgggcaatcagctggagcaggcgcgtgaaattctgcgcgatatcgaatcgctgctgccgcataacgaatcactgttccagaaggtcaacttcctgatgcaggcggcgatgggtttcatcaacatcgagcagaaccgcatcatcaagatcttctcggtggtctccgtggtgtttctgccgccgacgctggtggcctccagttacgggatgaactttgagtttatgccggaactgaagtggagcttcggttatccggcggcgatcggcctgatgattctggccggactggcgccttatctctatttcaagcgtaaaaactggctttaaaataagaacgggccatctgagatggcccgtttctgctggctcctgtccccatttctgcgtaatcttaccctcctgtgtttacaaattattaacttcttatggacgctttttcgttgcgcgcgcagtggacgctgctgctgctgatctcggtattgctgggcgcggtgctgcactattttcatgtgcccgctgcgctgttactgggaccgatgattgtgggtgtagtgatggggctgtcgggtgccacgctgcgaattgataaacggctgttcctgctcgctcaggccgtactgggctgcatgatttcgcagagtctgtcgccttcgattctggccccgctgattcaggactggccgatcgtgctggcggtgctgctgctgacgctggcggccagcggcctgtcaggttttctgctggtgcgcttcagtcatctgcctggcccgaccggcgcatggggatcgtcgccgggcggtgcaacggccatggtggcgatggcgggtgactttggcgctgacgtgcggctggtcgcattcatgcagtatctgcgggtgctgtttgtcgcctcggcggccgcgctggtggcacgcatcgggctgggtgatgaggcgcacagcgtctcgctgctctggtttccaccgctgaatcagggctttgttatcaccctggtggtgatgctgacgggcgcgtggctgggcacccgactgcgtattccttcaggcgcgctactgctgcctgcgctggcgggtgcggcactgcacagtagcgacatcgtggtgttacaggtgccggaatggctgctggctgtggcctatgcactgattggctggagcgtgggattacgtttcacccgcccgatttttctgctggcactgcgcacgctgccgcagatgctggcctcgatcttcgggctgatgctgttgtgtggcgggctggcgtggatgctgacgcgaatgctggatatcgatctgatgacggcctatcttgccaccagtccaggcgggctggacacggtggcgattattgcggcgggaacccaggtcaacatggcgtttgtgatggcgttgcagacgttgcgtctgtttaccatcctgctgaccggcccggctttagcgcgctttatttcacgttatgcgcgaacgggaaacggaatgaaaatgccaccgcatcgcagacaaataccagcagcgccagccagatgaagccaaaggtcaccatcttgtctggtgtgatggtctcaccgtaaaacgcgaccgccagcacaaacatcagcgtcgggccgagatactgaaagaagcctacggtggaaagtcgcagacggctgcaggccgccgcaaacagcatcagcggaatggtggttacaatgcctgccgctatcagcttcaggttgagactcagtgggttggcggataagtggctggtggcgctgtcggcaaagccaaacaggtaaatcgccgccagcggaaacagccacagagtttcaatcagcatgccgctctgcgcatcgacctgaatctttttgcgcaccaggccatacagggcgaagctcagcgccaggcccagcgcgataatcggtaacgacccaaactgccacagctgcaccagtacgccgacggtggccagcagcacggcgagccactgcaagcggcgaaaccgttcgcgcaaaaacagcatgccgaacaccacgttgatcagcgggttaataaagtagcccaggctggcttccagcatatgctgattgttgactgcccagataaacagcagccagttgccgccgatagtcacggccgtcagcgccagcagcagcacttttttaggctggcgcaacacgctgcgaacgccgggccagctgcggctcagggtaatcagtaacagcataaacagtgcagaccagatcacccggtgcgtcatgatttccgtggcgggaacctgctttaccagtttgaaataagcgggcgcaatgccccagataaagtaagcgcccagtgcaaagccaacgccctggcgggtttgttgcgtatccatatgcgatccattcaatggtgtggttagccgataagataggtggcggtagccgtggcgatataatcgccctgttgattgtgcagttccacgcgcgccacggcgactttgttaccggcgcgcagcaggctgctggtggcggtgaagcgttcgccgcgtccgggacgcagatagtcgacgcgcatatcaatggtacccatgcgtgacagacgctggcgcagatccgcttcgctgatgctttcctgacgggttaacgcattactgacgcagaccatgcccgccgccacatccagtaccgacgcgataacgccgccgtgcagaatctgctgcgcctggttgcccaccagcatggttttgttattgaagctgatctctgcgtagtctgcgtcaaggcgcatcagttccaggcccagcgcctgattaaacggcatgtgataaacgaaaatttcgccgaccagctggcgagcgtcctgctgtgtcagcacgggtgatgacatgatgatgtgtcctgaaaaaatcgggccagaggggcgcggaacatgaatgagttgtgtattctatgccgcctgcgagggtgtttccagtttaagaaatcagcactcatgctcactgccatttgcgtgtagaatggcctgctttttacgacaccctttcagttactttgatacgcagctgctcaccggagaattttatgcgtaagcatcgcgccttgctggcggcaatgttgatatttcctgcgctggcgcaggcggatgaagcccatattaaagaggttcatgacgcgccacaggttcagggcagcattattgctaacctgctggagaagcatgataacccgtttgttctctatccttacgagaacaactatctgctttatacctataccagcgacctcaataaagaggcgatctcctcctataactggggagagaatgcccgcaaagatgaagtgaaattccagctcagcctggcgtttccgctgtggcgcggtattctgggcgacaactcggtgctggcagcctcttacacccagcgtttcctggtggcagctgtcgaatagcgctgagtcatcgccattccgtgagaccaactatgagccgcagattttcctgggctgggcaaccgactattcgctggcgggctggacactgcgtgatgtcgaagtgggtctgaatcaccaatccaatggacgaagcgatcccacctcgcgcagctggaaccgcgtctatgcgcgtctgatggcagagaatggtaacttcctggcggaaatcaaaccctggtatcgtatccctgaaggggcgaacagcgatgataatcctgatatcaccaaatacatgggttactaccgcacccgtctgggctataagctcggcgacaatatcttcagcgtagagggcaactataactggaacagcggttatggcggcgcgaccctgggctggagctaccctatcactgagcacgttcgcttctatactcaggtgtttagcggttacggtgaatcactgatcgattacaaccatcgccagacgcgtctgggtgtgggtgtaacacttaacgacttgttctaatccataacgtaagacaggaatcgcgtggcaacctcggcagttcttaatcaggaagcgctggcgcagcaggtattgcaggataccttcggctaccagcattttcgtcccggtcagcagacgatcatcaatgaggcgctgagcgggcgcgattgtctggtggtgatgcccaccggcggtggtaaatcgctctgttatcagatccctgcgctggtgcgcgaggggctgacgctggtggtgtcgccgctgatttcgctgatgaaagatcaggtcgatcagctgctggcgaacggcgtggcggcggcgtatctcaactccaccatgacgcgcgagcagcagcagacggtgatggccgactgccgtaccggtagggttaagctgctctacattgccccggaacgcctgatgatggataacttcctggacagtctggcgcactggcaaccggcgatgctggcggtggatgaagcgcactgtatttcccagtggggccacgatttccgcccggaatatggtgcactcggcaagatgcgtcagcgcttcccggaattaccggtaatggcgctgaccgcgaccgcggatgaaaccacccgcaacgacatcgttaacctgctgcatatgcaggatccgctgatccagatcagcagttttgaccgccccaatattcgctacacgctggtggaaaaatttaaacccaccgatcagctgctgcgttacgttcaggatcagcgcggcaagtgcggcattatctactgcaacagccgggcgaaggtggaagacaccgccgcgcgactgcaaagccgggggttcagcgtcggggcataccacgccggtatcgacagcgagcagcgtggccgggtgcaggaagcgtttcagcgtgacgatctgcaaatcgtggtggcgacggtggcctttggcatgggcatcaacaagcccaacgtccgttttgtggtccacttcgatatcccgcgcaacatcgagtcctattatcaggaaaccgggcgagccggacgtgatggtctgcctgccgaagcgatgatgctttacgacccggccgatatggcctggctgcgtaaatgtctggaagagaaagtgcccggaccgctgcaggatattgagcgtcacaaactcaacgccatgggcgcgtttgctgaagcgcagacctgccgccgtctggtgctgctgaactattttggcgagggccgccagcagccgtgcgataactgcgatatctgtctcgacccacccaaacgttatgacggcctggttgaagcgcaaaaagcgctctccggtatctaccgcgtgggtcagcgttttggtatgggctatatcgttgaggtgctgcgcgggtccaacaatcagcgtatccgtgagcagggtcatgacaagctgccggtctatggactgggcaaagatcagagccacgaacactgggtgagcgtgttacgtcagctaatccatctggggctggtgacgcaaaacatcgctatgcattcggctctgcagctcaccgaagcggcgcggccggtgctgcgtggtgaagtgccactgatgctggcggtgccgcgtttaatcaccgcaaaaacaaaaagcagcagtccggcgaagtttcacggtggcaactacgatcgcaaactgttcgccaagctgcgtaagctgcgaaaagcgatcgccgatgaagagaatattccgccttacgtggtgttcaatgacgccacactgatagagatggcagaacagatgccggtcagcgcgtccgagatgctcagcgtcaacggcgtgggtcaccgcaaactggagcgctttggcaaacctttcctggtgatgatcaaagagcatcttgatgatgaagagtaaaggacactgattatgctgatgttattcgccactgtggcgctggtgcatctggtggcgctgatgagccccggccccgatttctttttcgtgtcacagactgccgccagccgctcgcgcaaagaggcgatgatgggtgtactgggcattacgctgggcattgtggtctgggcgggtgtggcgctgatggggctgcatctgattctggaaaaaatggcctggctgcatcagatcatcatggtcggcggtggactttatctgttgtggatgggctggcagctgatgtgctcggcacgtcagcgtcataaacagccgcagcaggatgagccggtggttgcgttgccgaaacgcggcatgagctttctcaaaggcctgctgacgaacctgtcgaatcctaaagccattatctacttcggcagcgtcttctcgctatttgttggcgacgatgtcggtttcggcggagcgctggggtctgttcctgctgattgtcggtgaaacttttgcctggtttacccttgtggcggcgatttttgcgctaccgtggatccgcgctaagtatcagcgactggcgaaatgggtcgatggcatggccggcgtactgtttgccggttttggtatccacctgattctttcgcgttaaacaccgtttcagcccttatgccggcgtgcgcgttgcgcctccggcagaaacctcccttgctgtcgcttcctccagagagtttgcttgtgtgacggatgtcacattccagggctcagggagttttgctgttgcaaccgcagataaatcgtcactctttattaatcattcatatccatatctccattaaagtcgggaagcaggcgcaacgtttatggagaggatgatgagagtgaagttcatattactggtgttgatgacggcctgtatcagcgcctgcgcctcgccggatgccgcccgcaaccctgcgccagagccgggccagaccgatgaggtcacctcgatcctgatgcagacgctgcccgatgtcgatcagacgcagggcgaaaggattagccggatctctgcgacgtttctcggaacaccctatgaagcggatacgctgatcggttctcccacgcgtccggaagcgctggtgatcaatttcaacggtgtggattgttacacgctgcttgattacgtgcaggcgctgagccgcagccacgatcgtgccagctttgaggctaacctgattcaaacccgctacgctggcggtgaggtcagctaccggaatcgtcgccactttttttccgactggtttgccgatagcccgcgcaatgccgatgacgtgacccgcactcttagcccggatacggtgacggtggtgaagcacctgaatcgtcaggccagcggagcagaacaggtgcccggtctgggtgtgattgcacgtcctgtcacttacattccggcccgggcgatcacaccgcaggtgctgaagcaaattcagaccggcgattacgtgggggtttacgccaccagtcagagcctggatgttacgcatgtggggattgctgtccggcatgatggccgcttgtggttcaggaacgcctcttcgctggccgttaatcgaaaagttgtcgatgcgccgttcagggaatatatgcgttcgaagccgggcatcattgtgttgcgtgcggttccactgacagcgccgtagcggggccagggaagaagggataatctttcgcgccgaattcggcgcgtcagacgttaagcgatttttctggcgctggccagcagcgcgcctactgccataaacagcccgccaaaaatgcggttcattaacttcatctgttttggtcccttaatccagcccgcaatccgcgttgccagcgtggcgtagccaatcatcacgatgatatcgaccacaacggtggtgacgcccagcaccagatactgcataaatagcggctgatgcggctgaataaattgcgggaacagggcggcgagaaagacgatacttttcgggttggtcaggttaaccagcacggcgcgtttgaacaggcgacgacgcggcatcgctctggcgaccgcatccagatcaatgccacccgctgagcgccactgctgaatacccagccagaccagataggccgcaccggcccatttcagaatctcaaacgccagcagcgactgagaaaacagcgcgcccagaccgatgccgaccagcacgatatgcagcgccaggccgacctgcaaaccggagatagaggccaccgtgccgcgatagccgtggctgataccggtactcatggtgttgattgcgccggaaaccgggcgacaggctgagaattgtagtggtaagcagataggtcagccaccattcgatggtcatgggtcaggctctctttagtagcggaattgtgacacaatacgccagaaataagcgcggcgctacggcctgcgcatggcattcaggactctgtatccggtcatcaggagggcgaatgaatcaacacaaagccagctggctgcgacgagaaaaagcctttgctgccttcgctaccgggccactgctcgatttctggcacagccgcgaagagcttgagtttaccggcgtgggtaatctgacgctgcgctacgtccgcttcacatcaccgcaacacaagcgtgtgatcctgattgtgccgggacgcatcgagagttacataaaatatcctgagctggcgtacgatctgtttcactgcggatttgatgtggtaatccttgaccatcgcggccaggggcgttccgatcgcctgctggaagattcacatcgcggtcacgtggcggaatttacccattatgtcgacgaccttgaaacgctctatctgaaagagattatcagcggtcactaccagcagcgctatgcgctggctcactctatgggcggcgcaatcttaacgctgtttctggcgcgtcagccgcaggcgtttcatgcggtcgcgctggtggcgccgatgtttggcattgctttaccgttgccctcttttctggcccatcggatcctggactgggcggagaagcgtccggccatgcgcgatggctatgcgctcggcaccggccgctggcgtgcgcatccgtttggcattaaccggctgacgcacagcaccgagcgttaccggcgaaatctgcgcttttatgcggacgatccggcgattcgcgttggcgggccaacctaccattgggtacgtgaaggcatccatgcaggtcgcaacatcatcagtcaggtcgataagatcaccacgccactgctgctgttacaggccagcgatgatcgggtggtcgacaatcgttcgcaggaccttttttgtgccgcgatggcagcggcgggtcatccgtgtgagggcaataagccacgggtgatcgacggtgcgcgtcatgagatcctgtttgaaaaagatgagatgcgcgccgaagcactcaatgcagtggtcgacttcttttcctcgcaccactgacgttatttatccgaccggttaaggccggcagaaccagacacccgaggttttcatgtatcacatcgttgcatccgatctggatggcacgctgctttctcccgaacatcgtctgaccccttttgcgcgtgaaacgctgcagcagctggtcgcgaaagatattcactttatattcgccaccggccgtcatcatatcgatgtcggacagatgcgcgacagcctggcgattccggcctatatgatcacctcaaacggcgcgcgcgtgcacaacgcagagggcgaactggtgttcagtcataatctggatgaggatatcgccagcgatctgtttggcctgcaatatcatcacagcgatattctgacccacgtttaccgcgacgatgagtggtttgtcagccgctcaagcccggctgagcaggactatttccgcgagtcggtgttcaactatcaggtctatgagccgggtctgctgccaaccgataatatcagcaaggtctttttcacctgcgaaaatcccgagcatctgatcccgatggaacaggcgattgaagcgcgctggggcgatcgggttaacgtcagtttctcactgcctacctgtctggaagtgatggcgggcggcgtgtcgaaagggcatgcgctggaagcggtcgcgaaaacgctgggccactcactggaaagctgtatcgcctttggcgacggcatgaacgatgtggagatgctgagcatggcgggtaagggatttatcatgcagaacgcccatcagcggttgaaagatacgctgccggagctggatgtgatcggttcaaatgccgatgatgccgtgccgcagacgctgcgcacgctctatcttgcttaagccgtcagcgcaaaaaaagggccggatatccggcccttttttattgccgtcaggcaggggtctttttgtgtttgtgttcgctgaccatggtcagtaacagcaggataaccgccagcacacagccagcaatcatcaccatgaagccgccgtcccagccgaagtaatcgacggtgtaaccgacaatggcgctggccgccaccgatccacccagatagccgaacaggccggtgaagcccgccgccgtccccgccgcttttttcggggccagctccagcgcgtgcagaccaatcagcatcaccggaccgtagatcaggaagccaatcacaatcatacaggccatatcgacgccaggattgcccgccgggttaagccagtagatcacggtcgcgatggttaccagcgtcataaagaacaccccggtcgcaccgcgattaccgcggaacactttgtccgacatccagccgcacagcagcgtttccggggatccccgcatactcatacaggaagtaagcccacgacgatttatccagcgtgaagtgttttacttctctgagataggtcggcgaccagtcgagaatgccgtagcgcagcagataaacaaacacgttggccagcgcgatgtaccacagcagcttgttcggcagcacatatttcatgaagatctgtctggccgtcagctcctcctcatggctggcatcgtagtcgggcggatagtcgtttttgtactcttcaatcggtggcagaccacaggattgcggcgtatcgcgcatcagcgcaaaggccagaatcgcaatggcgatggcgccaaatgccggcatatagagtgccgctttccagtcgttgaaccacgccataccgagcaggaacagcagaggcggaataccgccgccgacattatgggcgcagttccagaccgaaacgatcctgccgcgctctttctgcgaccaccagtgaaccatggtacgtccacaaggtggccagcccatgccctggaaccagccgcagataaacagcagcacgaacatcaccataatgctggaggtggcccagggaacgaatcccatgatcagcatcactgtcgcagccagaatcaggcctgccggtaagaagacgcgcgggtttgagcggtcagagaccgatcccatgatgaattttgaaaagccgtaggcgatggatatgccggataaggcaaaaccgagatcgccacgtgaaaaaccctgctctaccaggtagggcatggcgagtgcgaagttttttctgaccagatagtaggcggcgtaaccaaagaagatcccgatgaaaatttgccagcgcagacgacggtagagcggatcaacgtgatcctccgccacctgcggctgacgtggtgcaggtttaaaaatgctcagcatcagtgaggccctccagggcacattatggtttttaattcccagcaggttggggcaggaaaagagcagaagaaaatggacgcagaatgttccatttcgcgcaaagaatagtgttagttgcgcaacgttactgtgatgaatgacacatttgttacacttttattacattctggagcggaagtgatcatgcgatggatcatttcgcgcattttatctggctgaaagatctttatgcagacagttatgtcaggaagcgaaagcccttttccgatggctattctgatcgcctggtttgtaatcagatgtcaaccagatttcacagcctgatggcagcacattgtttacactgacggcctgttaatttcggggtcgtcaccgtgtttttattgattattaccaccattctgtgggccttttcgttcagtctgattggcgaataccttgccgggcaggtggacagctggttctctgtactgatgcgactggcgctggctgcgctggtatttttacctttcctgcgctggcgtggtcatcgcccttcaacgctgttgctttacatgctggtcgggatgctgcagctgggcgtgatgtatctgctgagtttcgaagcctatctctaccttagcgtgtcggaattcctgctgtttacggtgatgacgccgctttatgtgacgctgatttacgatctgatcagccgtcgtccactgcgcatcggctatatcttcagtgcactactggctgtggcgggtgcggccattattcgctatgacaaagtcagcgatcatttctggtttggtctgctgttagtgcaactggcaaatatctgctttgcggcgggaatggtgggctataagcgtctgcaggagacccgcccgatgccgcagcacaccgccttctcctggttctatctgggtgcggtgttgattgcggtgatcgcctggtgtgcctggggcaatccacagaagttgccgaccacctcattgcagtggggcattctggtctggctgggcattgcggcttccggtctcggctattttatgtggaattatggtgcgacccaggtcgatgccggcacgctgggcattatgaataacatgcacgtttcctgccgggctgctggtgaatctggctatctggcaggagaaaccgcactggccaagctttattgcgggcgcgctggtgatcctcgcctcgctgtgggtgcataagcgctgggtggtgggacgcggtgaccgatcataaacagggctgttgcatgggtgcggcctcccgggctggcgcgtccgatcgcgaaggaatctcacatccctgtggatcggccgggccatccctggcccggacgcttcgctcttcagacgcgccagccctggagacttaacagcatcatcgcagttgaaccaggggctcagagcgaatatgaaggaggggatggagcgctgaaacgtagagcattcgcgatggagctggcgtgtgcgatcgcgaaggaatcttccaggatggttcagaaatgctcccggcgcttttttcccctgcgacgaaggctctaccgatgacccgctttcactccccatggctggcctggtgttgctaattaaaaagccatgaagaagcttaaaggaagaggtggcgcaactgaggagcaaagcgtccgagccagggatggcgaggccgtgctgcatggatgcaggctttctttgcgatcagatgcgccacttctgaccacgcaggtacccgaagcgatcagccacagacgttaagcaggcttttcactcttaggacgctgaatcatcgccagccctttcaggaagttacgcagaatctgatcgccgcattcgcggtagttcttatgatcaggtttgcggaaaatcgcaccaatctcagcctgtgaaacggtaaaattcacgcgcttcagtacatcaggaatgtcggtggttttcagatcaaaagcgatacgcagctttctcatgaagatgttattagtcatcttgcgctcaatcgacggcgcgggcgcatcttcacttttgccgcgacggtagaagatcaggccattcaggaaataacccatcagcacatcggggcaggggcggaaacgcagcatcgtcatcttttttcagccacgcctgaatatccgccagcggcacgtcacattgcgccagcgcaaaaatctccaccattttggcatcgctcaggttgagcatatagcgcacgctgcgcagaatatcattgttagtcatggtgaaattttctcgtggtcagtcgacaggctgcgcattataggggattttgcccgccttcgcgcaggtttgtgcccgccagattatcgctgcaacaccgcaccgggcagcgcggcgtcgcgcacaaaaggcagatgctcacaggcgtgctgacgggcaaagcggataaacgcttccagcaccggctgacgttgctccccttcgcgcacggccgcataaagacggctccacaggccatcgcccagcgtgcgggtgaccaccagaccctgcttctcaaaactctcaaccacccagtgcggcagtgcggcaatccccatacgcgccgagaccatctgaatcatcagcagggtgttatccacacttttcagtgccggactgacgcctgcgggctgcaggaagtgacgccagatatccagacgctgacgctgcaccggatagatcatcaacacctcatcggctagatcttccggcgaaatctgctcaacctgcgccagcgggtgatccgttgccagcaccagccgcacttcataatcaaacatcggggagtagaacagacccgagcgcgccaggatatcggaggtcagcaccacatccagctcaccctgttgcagggcgggttgaggatcaaaggtcacgcccgatttaaaatccatcaccacctgcggccagctctggcggaatttatccagcgcgggggtcagccactggatgcagctatggcactctatcgccacccgcagcgtggtctgatgcggctcatggcaggcctgcaatgcctgctgaatctgcggcagcacctgctctgccagctgcagcagaatatcgccctgcggcgtaaagcgcagcggctgacttttacgcacgaacaggcggaatcccagccgctgctccagatcgctgaactgatgagacaacgccgattgcgtctgatgaagctgggccgccgccgccgccagcgagcccgtattgcgcagagcctgaagcgtccgcaggtgcttgagttcgatcatgagagtccttcacatcgaaaatgaacatattgcgcttgagcaatatacagtacccgcagagtatagcagtgtaaacatctggacggctaaacatctttggctgcccatttaagccaaagtgaaagattatctggagaacagcacatgactatcctgaaccataccctcggctttccccgtattggcctgcgccgtgaactgaaaaaagcgctggagagctactgggctggcgacagcacgcagcaggcattactggcgacgggccgtgagctgcgtgcgcgacactggcaacaacagaaagaggcgggtgtcgatctgctgccggtcggcgatttcgcctggtatgaccatgtgctgaccaccagcctgatgctgggcaacgtgcccgcgcgtcatcagaacaaagcaggcactgtggacctcgacaccctgttccgcctgggacgcggtcgtgcgccgaccggcgagcctgcggcggcggcagaaatgaccaaatggtttaacaccaactatcactacatggtgccggaatttacccagggtcagacgtttaaactgacctggacccagctgctggacgaggtggatgaggcactggcgctgggacacaacatcaagccagtactgctggggccggtgacgtatctgtggctgggtaaagtgaagggtgagccgtttgaacgtctttcgctgctggagggaattctgccggtctatcagcaggtgctggcggaactggcaaagcgcggcatcgaatgggtacagattgatgagcccgctctggcactggagctgccgcagacgtggcgcgaagccttccagccggcgtatgacgcactgcagggtcacagcaaactgctgctgaccacctattttgacagcatcggccagaacattgatgtgattcgttcgctgccggtgcaggggctgcatgtcgatctggtccatggcagtgatgatattcaacaactgaatcagcaactgcccgccagctggctgctgtcgctcggcgtgatcaacggacgcaacgtctggcgcgccgatctgagccgctggttcagccgcttgcaaccgctgacaagagcgcgtgaacaggtgtggatcggctcctcctgctcgctgctgcatagccctatcgacctgagcgtcgagacccgtctggatgatgaagtcaaaagctggttcgcctttgcgctgcagaaatgtgccgagctctcgctgctgagtcaggcactcaacaacaacgatgcgacggcgctggaagcctggagcgcaccggtacacgcccgcgctcactcccgccgcgtgcataatgcggcggtgggccagcgtctgcaggccattaccccacagcacagtgaacgccagagcgcttatccggtgcgggctgtcctgcagcgtcagcgttttaatctgccagcctggcctaccaccaccatcggctcttttccgcagaccactgaaattcgcggcctgcgcctcgactttaaacagggccggctcgacagcaaccattaccgcaccggcatcgcggagcacattaagcaggcgattctcgaacaggagcggctggggctggatgtgctggttcacggtgaagcggaacgtaacgacatggttgagtacttcggcgaacatctggaggggtttgtcttcacacagaatggctgggttcagagctacggttcacgctgtgtgaaaccgcctgtcattattggcgatgtcagtcgtccggaggcgatcaccgttgagtgggccagatatgcccagtcgctgaccaacaagccggtaaaagggatgctgaccggtccggtaaccatcctctgctggtcattcccgcgtgaagatgtgtcacgtgaaaccatcgcgaaacagatcgcgctggcgctgcgtgatgaagtcgaagacctggagaatgcgggcatcgggattatccagattgatgagcctgcgctgcgtgaaggtctgccactgcatcagtctgaatgggccgcctacctgaactgggcggtggaggccttccgactgaatgcggcggtggcgcgggatgaaacccagattcacacccatatgtgttactgcgagttcaacgacatcatggacgctatcgcggcgctggatgccgatgtgatcaccatcgaaacctcgcgatctgacatggacctgctggaggcgtttgaaaacttcgactacccgaatgaaatcggccccggcgtctacgacatccattcgcctaacgtccccagcgtggagtggatagaagcactgttgcttaaggcggcgaaacgtattccggaagcgcgtctgtgggtgaacccggactgcggtttgaaaacacggggctggacggaaacgcgtcaggcgctggcgaaacatggtgacggcagcgaagaaattgcgtggagaaacggcgtagggaatcgggtctggtggacgaaaaaatcaggggcgcataagcgcccctttttcatttactgcgatgcaacaccatactgcctgaaccaggccagcatccgctgccagccatcattggcagattcagcatggtagcttgcacgatagtcagcattaaaggcatggcccgcttcgggatagacgatgatctctgcggttgcattggcggcatgcagtgcctgacgcatctgctcgacgctctccagcgggataccctcatcctggccaccatacaaacctaatactggcgcattcagatcgaccgcaatatcaataggatgtttctgctgcttcagcgtgcgctcaccggtcagtcgtccataccacgccacggcggcgcgcagttgcgggttatgcgcggcgtagagccagctaatgcgaccaccccagcaaaaaccggtgatgcccatgcgacgaatatcgccgccgttgcgtgcggcccagttagcggcatgatcgagatcggccagcacctggctgtcaggcactttgctgaccagctcgctgaacagcgtcgggatatcattatactcagcgggatcgccctcgcggaaatagagctcaggcgcaatcgccagatagccttccagcgccaggcggcggcagatatcccggatgtgttcatgcacaccaaagatctcctgcacgaccagtacgactggccacgggccttccgctgactggggttttgcaaagaatgccggcatattttcgccctggctgggcactgaggtttcacccgcgtgaatcgccgggctgtctgtaatgatggtggtggaggcggtgggctgcacggcaggggcaaagccgcccgtcgccggtttttgtgccatattatcactgggtttcattattctctccgtgcaagcatttgcgcaatcacgtaactatagcctggccggaaagcgtatgcgccaggtgtcgggtcacagaatcagcagcgaataaaatcatccttctctttaacattgcgcagaccctgacacagccccaccgagagctatccgcaccaggaagatgctattgtgtgattgtcgtcacaatttatctttcgggaaatgtaactttcattttcttaagtgaatgttgtcacatatttattgggcgtgctggcgtagagtggcgcgctaccttcccttaacaggagtctgaaaatgacacagtctgacgttttccatcttggcctgaccaaagccgatctgcagggcgccaccctggcgattgtgccgggcgatccggagcgcgtgaagaaaattgccggactgatggaagatgccacgcatctcgcctcacaccgtgaatttacctcctggctggcaaaaattgatggtaagccggtcgtggtctgctcaaccggcattggcggtccttcgacctcgattgcggtcgaagagctggcgcagcttggcgtgcgtaccttcctgcgtgtcggtaccacgggcgctatccagccgcatatcaatgtcggcgatgtgctggtgaccaccgcatccgtttcgcctggacggggccagcctgcattttgcgccgatggagtttccggcagtggctgatttcgcctgcaccaccgcgctggttgccgccgcagaagcctgtggcgcgaaaacacatattggcatcacggcctcttctgacaccttctatccgggtcaggagcgctacgacaccgtctcgggccgcgtagtcagtcgcttcaggggatcgatgaaagagtggcaggagatgggcgttctcaactatgagatggaatccgctacactgttaaccatgtgcgccagccagggtctgcgagccggcatggtggcgggcgtgattgtaaaccgcactcagaaagagatcccggatgcggtcaccatgaaacagacagaaagtgacgcagtgaagattgtggtcgaagcggcgcgtcgcttactataacgaccgcgtctggcagcaggttttttgtccagactcaaaacctgctgccggtagttaacggcgcgtaatatcagtgaaacctgagagtttttatgcgcaatactattcccgtccgacgtcctgcccctggtgctaatccggccgcactcaaagccatgctggaacgcagtgccgaacgtttccgtgccgccatgcaacagggcgactatgcgctggccgctcaatgctgtgaagaggtattgcgcacgatgcccaatcagatgcaggtgctgagcgactacgcgctctgcctgctgcgtctgggtcagtacaataaatcgtacaaaatctaccagaaaatttatcagtcaccgcccgctgtacagtctaccgcctctgaaacctggctggatggtctgaccgaagtgtgtggctggctggataaaaaggacgaggtggcgcgtcatgggctggcctcgctgatgcgctctgatgcgcgtttcagtcaggggcagcgcgccgcgtttcccgctccgcaaccggagcctgtcgatctcactcatccgcaccagaatgtcatcgctttctgcctctatggcgatcagccgcgctactgtgaaaccttaatcaaaaacgttgaagtggcgcttgaactctatcccggctgggtctgccgcatctatctcgatgacagcgtgccgcagcatgtctggcagcgccttgaccagccgcacgtccagctgatcgatatgtcccacgagaaaacgctgtttccgaccctgtggcgtttcctggtaatggacgatccgggcgtgaagcgttttatcgtgcgtgatgccgactcgctgctctcggagcgcgaagcggcagcggtaaacgcctggctggcgtcgccttactggttccaccatatgcgtgactacttctcccatactgagctgctgctggcagggatgtggggcggctgtcacggcgttttccgggatgtggaacaggcgatgcgcgatttcattgcgcagtatcagggcagccagcgcttcaccgatcaatatttcctcaaggtggcgttgtggccgacggtgcgtgaaagcctcctgagccacgatgagttgtttcattttcatcaggcccagccgtggcctgaccatgcccccgtgcgctggcagacgccgcatttccatgtgggcagcaatgccggttttgccagtatgaccggcaaatccagcgccgctgagggaagcagacagcgcgtcgcgattacctcgggcgggacaacctggcactatctggcgcaggttaaaaagggtgaatggctattgcccatgccgtttttcctgattgatgagtggcaggctggcaagctcacggtagcggcgctgtaaggcgctgaatcctgctaaaattatctggacattcatacagtgcgactctacctttccctcagcagcctgagtcgcgggggaaatcatggatcagcacatcattatcagcgcctgtctggcgcttgccgggttagggattggctggatgctggcacagttacgtgccggccatcaggtcgccagtttccagaccgagcgccgtctgcaggaagaggcgcaacagcgtcagcagcagcaaatcgaacagcttcagcagcagacgcagcagcgtgagcaggagcttcgtcagctgcacggtgctctgagcggcgccaatgagcggctgcaacagcttgattactggcgtaatgaaagtgagcagcttaatcgtgaactgcgcaatcagctggaggtcaacagcgcgcaggaagcggagctgcgtgaggtgaccattcgccttgaagagacccgtttcgccgcagaagagaaacagcgcctgctgaccaacagcgaacaacgccttagcgcccagtttgaaaacctcgccaaccgtattttcgaaaacagcggccgtcgcgtcgatgaacagaaaccggcaaagtctggacgggctgataggcccgttgcgtgaacagcttgatggcttccgtcgtcaggttcatgaaagctttggcgcagaagcgcgtgagcgacataccctgacccatgaaatccggcagttacagcagctgaatgcgcagatggcgcaggaggcgcttaacctgaccaaagcgctgaagggcgataataaaatccagggtaactggggtgaagtggtgctgagccgggtactggaagcttccggactgcgtgaaggctacgaatatgaaacccaggtgagcattcagtcagaacagcagggcaggatgcagccggatgtgattgtgcgcctgccgcagggcaaagatgtggtggtggacgccaaaatgacgctggtggcctatgagcgctacttcaatgcggatgatgagatcgaacgagagcaggctattcaggaacatgtcgctgccatgcgggcgcacatccgcctgctgggacgaaaagattatcaacaattgcccggcttacgatcgctggattatgtgctgatgtttatcccggtggagcccgcctttttgctggccattgaccgccagcctgagctgattggtgaggcgctgcagcagaacatcatgctggtcagccccaccacgctgctggtggcgttacgtaccattaataatctgtggcgctatgagcatcagagccgcaatgcacagcgtattgccgatcgggcaacgcggctctatgacaagatgcggctgtttgtcgatgacatgagcggcattggtcacagcctggataaggcgcagaacagctatcgcgaggcgatgaaaaagctgtcagaagggcgcggcaacctgattgcgcagactgaaggatttcgtgcgctgggcgtggagatcaaacggccaattaatcctcagctggccgaacgagccatgccggaaaaccgggcggctgatgacgcagatgatgacagtgatgcggatgagagtgagatgcatgtgaggcgcctccacgaatagtatgggcgcagcgtgcctgacttccgtgactctgatacacttcgggaagtattgtttgtggagcaggtaaaaccgatggcagatgaatcacagcaggaaactacccattttggctttcagacggtcgccaaaagcgaaaaagctgacaaagtcgcggacgtgtttcactccgtagcggcaaaatatgacctgatgaacgatttgatgtcgtttggcgtccatcgtatctggaagcgttttaccattgacagcagcggcgtacgtcgcggtcagcgcgtgttggatctggcgggtggtaccggcgatctgacggctaaattttctcgcctggtgggcgaaacgggtcaggttgtactggccgatatcaacagttccatgctgaagatgggccgcgaaaagctgcgcaatcagggcgtggtcggcaacgtgagttacgtacaggccaatgccgaagccctgcctttccccgataactatttcgactgcattaccatctcttttggcctgcgtaacgttacggaaaaagagaaggcgctggcctctatgttccgggtactcaagccgggcggacgcctgctggtgctggagttctctaaacccgttctggatccgctgagcaaagcgtatgacgcctactcgttccacattctgccgcgtatcggacagctggtggcgcaggatgcagagagctatcgctatctggccgaatcgatccgcatgcatcccgatcaggagaccctgaaagcgatgatgaacgatgttggttttgaaaataccacttactccaatatgaccggcggcattgtggcgctgcatcgtggatttaagttctgagtgagatggtaatgaacctgacgcccttgattaccgcgggcctggaaacggcgctgaaccgtattctctatcgcgatcgtggcctgaaaccggcgcggcaacgcctgaatggcaaagtgctgacgctgcgcctgaatgagttctctcatccgctggtgctggtcttcagtgaacagcaggtcgatgtgttggctgactggcaggatcgcagtgactgcacggtgatcacctcgctgaaaaccctgccgaagctgcgcgatcgccagcagctgacgccgctgatccgtagcggtgaactgcaggttgaaggcgacctgcaggtggtgcagcagttttctctgcgctgatggatctggctgagctggatccggcagaatatctggctccctgggtcggcgatatcgccgcacaggggatcagccagcgctcacaacaggcattacgctttttcaaaggtgaagtgcagcgtcgccaggattatctcggacaggccataaccgaagagtggcgtattgcgcctggctcgctggaattagcctggttttctgaggaggtcgacgcgatggaacgttcgcttgaggcgcttgatgcgcgtctggcgcagctggaggcaaaatgagttttggagagatccgccgcttatatctgatcatgaaggtgtttctgacctatggcctagatgaactgattcctcagacacgcctcactttcctgtttcgcctgtggcgtcgctctgttttctggatccctaatctgcatcagcatgaaccgatcggcgcacgtatgcgcatggcgatggagcagctgggtccggtctggatcaagtttggccagatgctgtcgacccgtcgtgatctcttcccgccgctgattgccgatcaactggcgatcctgcaggaccgtgttgcgccgttcgatggcgtcaaagccaaagcgcagattgaagcttcaatgggcgcgccgattgaaacctggtttgatgattttgatatcaagccactggcttcggcatccattgcgcaggtgcacaccgccacgctgaaatcaactggcaagaaagtggtgatcaaagtgattcgccccgatattttgccggtgattcgggcggacatgaaactgatctatcgcctggcccgctgggtcccgcgcctgttgccggatggccgtcgtctgcgtccggtcgaagtggtgcgcgattatgagaaaaccctgcttgatgagctgaatctgttacgtgaagcggccaacgccattcagctgcgccggaattttgaagatagccgcatgctctatgtgccggaagtctattccgactactgcagcgaaaccatgatggtgatggagcgcatctacggcattccgatttcagatgttgccacgctggagcgtcatggcgttaatatgaagctgctggcagaaacgtggcgtgcaggtcttcttcacccaggtcttccgcgacagcttcttccatgcggatatgcatcctggcaatatttttgtcagctatgaacatcccgaagatccacaatatatcggcatcgattgcggtatcgtgggttcactgaacaaagaagataagcgctatctggctgaaaactttatcgccttcttcaaccgtgactaccgtaaggtcgcggagttgcacgttgactcaggctgggtgccgcccgataccaacgtagaagatttcgagtttgcgattcgtacggtctgcgagccgatttttgaaaaaccgctggctgaaatctccttcgggcatgtgctgctgaacctgttcaacaccgcacgccgctttaatatggaagtgcagccgcagctggtcctgctgcaaaaaacgctgctctatgttgaaggcatcggccgtcagctctatccgcagctcgacctgtggaagacagccaagcccttcctggaagagtggatcaaagatcaggtgggattaccggctattatccgtgcggtaaaagagaaagcgccattctgggctgagaaactccctgagctgccggagctgttttacgacagcatgcgccagcacaaacttttgcggcacagcgtcgataaattagtgggcgatatgaatgcgcagcgcgtccggcaccatcaggcgcgttacctgttcggcgtcggtgcaacgttgctgttaagcggaacggctgtgctgctcacccgaccggattgggactttttcccggcggtgttgatggcagcaggaattgtctcctggttaatcggctggcgtaagacaaactgattgtcacgtccgtctaaaaaaaggtaatgtcgctggctcaggcccggttgaaaagggcactctgtggtgcattacctcatcgttttcacagaatattagaggctatctcatgggcggtatcagtatctggcaattgttaatcattgccgtgattgttgtacttctgttcggtaccaacaaattacgtaatctgggttcagatttgggttcttcgattcgtggcttcaaaaaagccatgggtgacgaggacgacaaaaaggatcaaccgaaagagcaggacgctgacttcgctgccaaaacgctggcggacaaacagcaaacttcggctaacaaagaagaagccaagaacgacaagcaggtgtaaaccgtgtttgatattggttttagtgaactggtattggtgttcgtgatcgggctgattgtactcggcccgcaacgtttaccggttgcggtgaaaaccgtggtcggctggatcagggcgattcgttcgctggcagccaatgtacaacatgaactggcgcaggagctcaagctgcaggagttgcaggagagcctgaaaaaggtggaagaagcgggccgtggcacgctctcacccgagctgaaagagtcgatggaagagctgcgtaaaactgcggattcaatgaaacgctcggtcagtcagagcatcgacattgaaaaagaggaagacgaggcaaacaccatccattcggctcagcacaggcccgcgcctgctccggctgagccttcggcgacaccggctacagcagaacatcaggccagtgccccggcacagacaccgtctgcggtttcagactcaggcccggcggtgcagccctctgccgcaccttctgccgtcgccaatgctcctgcaccggcttcttcagcggtttcatcaggtccggcggtgcagtcctctgccgcaccaaccgctgtggccagcgcaccggcacaggcgcccgctggcgacgttgccaggccggcagatcctgcgcgtcattccgctaccccctcttctgcaagtgatgaacgataatggccgttgaagatacccaaccgctcatcagtcatctgattgagctgcgtaagcgactactgaactgcatcattgccgtattagcgattttcctggtgctggtttatttcgccaacgacatctaccagctggtcgcggcaccgctaatcagccagatgccggtgggctccagcatgatcgcgaccgatgtggcctcaccgtttttcaccccgattaagctgaccattatagtgtcggtgtttcttgcggtgccggtgatcctctatcaggtctgggcatttgttgccccggcgctttaccggcatgagcgcaggctggttatgccgctgctgttttccagcaccttcctgttctacttcggcgtggcctttgcctatttcgtggtcttcccgctggcatttggttttttcaccaagacagcgccgatcggcgtgactgtagcaacggatatctccaaatacctcgattttgtcatgacgctgtttatggcatttggcgtggcgtttgaagtgccggtggcgattgtgttgctgtgctggaccggtatcaccagcccggaagagttgaagaagaaacgtccctatattctggtgggcgccttcgtggtcgggatgttgctcacaccgccggatgttttttcccaaactttgctcgctattccgatgtactgcctgtttgaagtcggcgtattcttttcccgttactatgtgggtaaaggccgccggttacaggatgaagaagagaataccgactcctgatgcggacagctttacccgcactggcgggaagcgatcaatccaaaccgccctgatgggcggtttttgtttataaactgtgggaaaaattatgtttgatatcggtgtaaacctgaccagcacgcaattcgcctccgaccggcaaaaggtggttaaacgcgcgcgtgatgcgggcgtcaccggcatgcttattaccggcactaacgcgctggagagccagcaggctcagcgactggctgaagatcaagcgggcttctgttggtctaccgcgggcgtccatcctcatcatgccagcgaatggtcaacggaaattgccagcaccctgcgtcgcctggctgaaaaaccggaagtggttgccatcggtgaatgcggactcgatttcaatcgcaatctgtcggctcatgagcagcaggagtatgcgtttgatgcgcagctggctctggcggcggaactcaatatgccggtctttctgcactgccgcgaagcccatgcgcgtttcgccgcagtactggcgccctggctgccaaaattgcctggcgcggtaatccactgctttaccggcacgcgtgacgaactggaagcctgtctgggcatgggattatcggtagggattacgggctgggtatgcgatgagcgccgtggtctggagttgcgcgagctgctgccactgattccggccgatcgcctgctgctggaaacggatgccccatatctgctgccgcgcgacatgcgtccacgcccgacttcgcgccgtaatgaaccctgctttttaccgcatattgtgcaccaggtggcgacatggcgtggtgagagtgctgaggaaactggcgacccgcatcgaccataatgcgcggacgttattcagactggcttaaatcttgcggaactgcttgttgtcgacgctgcgcattacctgcttgttcagcaaattaagcaacagaattgagcgcgtttcaccatccggctcggcaaagatagcgcgcagcccttcaaacgtcccgtcggtgatgaccacttcatcaccgctttgcggcgtttcagggtcaagcaggatttgcgggacgtctgtttccagcgcttcaatcacggctgaaggcactgtcgcgggcgtcgtgccaaagcgcacgaagtggctgacgccacgggtgctgctgatcgtcgtggtgtgaatggcttccggatcaaactcgataaacagataattcgggaacagtggctcactcacggtggtgcgtttaccgcgcacgatcttttccagagcgatcatcgggctgaggcaatgcacttcctgccgctccagatgctccttcgcgcgcagtagctgtccacgtttgcaatagagtaagtaccaggattccataactgctcccattgaatggacgctaagaatagcaaacctgttgccagagttatagcgcaggggcagggtaaagcgtcccgcaaagaaaataaactgagacttttcttaagatgcccgatggcagcagaaaaggtgactgaaaattgacgtctgctattgctctgtatcagactcaatgaccatcacatctgcaaaaggatcctctgatggaactctttctgttgagcaacggcaagctggcggatgatgcgccgctgctgggctatgcgcagccgcagctgcacgccatgatcgcccgacgcgctatccgctcggcggtactgatcccctatgcgattattcgtggcgatcagcagcaacgcgccgccgaactcagtgcctctttgggcattcaggttgagcgggttcaggcattcgcctcaccggctgaagcgattgcgcaggcagagctgattttagtcagcggcggcaacacctggttcctgaatcagatgctgcatgagcagggtctgatcggggcgattcagcgcgcggtgcgggagcggcaggtaccttatgtcggctggagcgcaggctgcaacgtggcgacgccctcaatccgtaccacgaacgatatgccggtgcgcagcagcgtggtgctgcctgcgctgggactctttccggtgcagattaatccccactatctggatgccagcgtcagcggtcatatgggcgaaacccgtgacgaacggctggcagagttctgtgcagttaatccgactgagtcggtgattgcactgcgtgaaggcagttttctgcacgttcacgacaatcagctgcgctatcacagcgtgcgaaacgaagattttaaactgtttcgccacggcgagccgattcaggggtatcacgatgcccgcgcgttacaaccgctggttccctttcagtgcgtatgacgctgccatataaacctcagcataaccgcttaatcagacctataatggccgattcactctggccggaaagctaaagccgcatgaaatatcacgatttaagagactttctcgcgctgctcgaacagcgcggtgagctaaagcgcattacccagtcgatcgatcctgaactggaaatgaccgaaatcgccgaccgcactctgcgtgccggtggcccggctctgctgtttgaaaacccgaaagggtacgacatgccggtgctgtgcaatctgttcggcacaccaaagcgtgtggcaatgggcatgggccaggaagaggtcagcgcactgcgtgaagtgggtaaactgctggccttcctgaaagagccggagccgccaaaaggcttccgcgatctgttcgataagatgccgcagtttaagcaggtcctgaacatgccgaccaaacgcctgcgcaatgcaccctgtcaggaagaggtgttcagcggcgatgaagtcgatctgacgcggattccggtgatgaagtgctggccgggcgatgcggcaccgctgattacctgggggctgaccgtgacgcgcggcccgcacaaagagcggcagaatcttgggatctaccggcagcaggtgatcggcaaaaatcgtctgatcatgcgctggctgtcgcaccgtggcggtgcgctcgattatctggagtggacgaaagcgcatccgggtgagcgttttccggtctcggtggcgctgggtgccgatcccgccactatccttggggccgtaacaccggtgcctgatacgctgtcagaatatgcgtttgccggtttactgcgcggcaataaaactgaagtagtgaaatgcctctcgaacgatctcgaagttcccgccagtgcggaaattgtgctggaagggtatatcgaagcgggcgatatggcgccggaaggaccttacggcgaccacaccggctactacaatgaagtagatagcttcccggtgtttaccgttacgcatattacgcagcgccataagcctatctatcactccacctataccggccgtccgccagatgaacctgcggtgctgggtgtggcgctgaatgaagtgctggtgccgattctggtgaagcagttcccggagatcgtggacttctatctgccgccagaaggatgttcataccggctggcggtcgtgacgattaaaaagcagtacgcggggcatgccaaacgtgtcatgtttggcgtctggtcgtttctgcggcagttcatgtacaccaaatttgttattgtgtgtgacgatgacgttaatgcgcgtgactggaacgacgtgatctgggcgatcaccacgcgtatggatccggcccgcgatacggtattagtggaaaataccccaatcgattatctcgatttcgcttcgcccgtttccgggctgggatcgaagatggggatggatgcgaccaataagtggccaggtgaaacgcagcgcgaatggggtacacctatcgtcaaagatcctgcggtcaccgcgcgcattgatgctatctgggatgagctaggtatttttgatcagccgccacagcgttgatggcgagcacaaccataaagacgacccgacagagggaacgcatgacaacgttaagctgtaaagtaacttcggttgaggcgattaccgacacggtctatcgcgttcgcctgatccctgaagcggaattcagttttcgcgcgggacagtatctgatggtagtgatggacgagcgtgacaagcgtccgttctcactggcctcaacgccgatggaaaaagatatcattgagctgcatatcggcgcgtccgatctgaacctctatgccatggccgtcatggatcgcatccgtaacgatcgccagattacggttgatatgccgcacggcgatgcctggctgcgtgaagagagcagcaagccgctgattctgattgcaggcggcaccggtttctcctatgcccgttcgattctgctcactgcactggcggaacagccagagcgcgatatcgccatttactggggcggacgtgagctcaagcatctgtacgatctggaagagctggatgcgctggcggtgaagcacccgaatctgaaggtgatcccggttgtcgagcaacctgaagcgggctggcagggccgtttcaggcacggtactgacagcagtgatgcaggacttcagtacgctgagcgagcatgagatctacatcgccggacgttttgagatggcgaagattgcccgcgatcgtttctgtgccgagcgtggcgcggtggagtcacagatgtacggcgatgcgtttgcctttatctgattccctgtagcagcctgtagcagacagaaaaaacccgccgatttactggcgggtaaatctgacaaagtaagactcaacgtattacagacgctcgaatacggtcgcaatgccctgacccagtccgatacacatggtggcgaggccaaaacgggcgtcgcgtcgctccataatattcagcaacgttgtgctgatgcgtgcgccggagcagcccagcggatggcctaacgcaatcgcgccgccattcagattgaccttatcatctatccgttccagcaaacctaagtccttgatgcagggcagcgtctgcgcggcaaaggcttcgttcagctcaaacacatcgatatcactgacgctcagtcccgcccgtttcaatgccagtttgctggccggtaccggtccatagcccattatcgaaggatcacagcccaccaccgccatgctgcggatgcgcgcgcgcggtgtcagccccagctcacgggcgcgtgattcactcatgaccagcatggcgaccgcgccatctgacaacgccgacgatgtacccgccgtgacggtgccgttaaccggatcgaaggcgggtttgagtgccgccagtccttcggcgctggtctcctcgcgaatcacctcatcgaagtcatagcgtttaagaatgccgtcgctgtcgtgaccataggtggcgacaatctctgttgcaaagtccccacgctgggtggcctgccaggcccgctggtgtgaacgcagggcaaatgcatcctgctgctcacggctgatatgatgcatccgcgccagcatttcagccgttaagcccatcatgcctgctgcttttgccacagtacggcccagaccgggatgaaagtcgacgccgtgattcatcggcacatgtcccatatgctccacgccaccgatcagacagcactgcgcatcgccgaccataatggcgcgggccgcatcatgcagcgcctgcattgaagagccacacagtcggttgacggtggtggccggcactgaatgcgggatttcggccagtagcgcggcgttacgcgcgatattaaatccctgctccagcgtctgctgtacgcagccccagacgatatcgtccagtgatgtcgggttcaccgccgggttgcggctcaggagttcgcgcatcaggtgcgcagagagatcttcagcgcgcacgtgacgaaaggcgccgccttttgaacgtcccattggcgtgcgcaccgcatcaataatcaccacattttccatctttttgccctcaggcgcttttcagcgcggcttcatcaatcggtttggcggcgggataccagctttcatgctgatgggctttctgcaccagcagcgcaggcagggcatataagcctccgagcgcgctataacgccgggcctgatccaccacgttgctgttgcccagggtatcgagatagcggaaagcgccgccacggaaaggcgggaagccgagaccatagaccagcgccatatccgcttccgctggcgaggcaataatcttctcttccaggcagcgcactacttcattcagcattggcagcatcatacgattcaggatctcttcgtcgctgaagacccgcttaggctggcagacctgctccagcagcgtatccacttcggtatcagccacttttatcagcttgccctttttatcttcttcccagcgccagaagcctttgccatttttctggccaaaacgaccggcatcaaatagcagatcgatcgcatcacgatagtcatgcttcatacgatccgggaaaccgtcagccatgacgctttgcgcgtggtgcgcggtatcgatgccgaccacatccagcagccatgaggggcccatcggccagccaaactgtttttccatcactttatcaatctgacggaaatcggcgccgtcgcgcagcagcaggctgaaagcggcgaagtaagggaacagcacccggttaacaaagaagcccggacagtcattcactacgatcggggttttgcccattttgctggcccaaaccaccactttgctcagggtcgcttcactggttttctcgccacgaaccacctctaccagcggcatacgcggtaccggattgaagaagtgcatgccgcagaagttttccggacgctgcagcgcctgcgccagctggctgatgggaatggtcgaggtattggaggccagaatcgcatcttcacgcagatgctgttcggtttccgccagcacttttgccttgatcagcggattctctaccaccgcttcaaccaccacatcagcctgttcaaaaccggcgtaatccagcgtgggctggatagtggcgatcacactggcgagtttgttgccgtcgattttgccgcgtttccagcagcttattgagcagcttgctggcttcgttcatccccagcgttaacgcctgtggattaatatctttcattctgaccggcacgcctttccacgcagactggtagctgatgccgccacccatgatgcctgcgcccagtaccgctgcctgagcgggtgcgccgctttcgctgccgcgctttttcgccagacctttcacgtactggtcgttgaggaagatgccgaccagcgcgcgtgcttcatcagactgggccagcggcacaaacgctgcggtttcaagtttcagcgcgtcatcgcggccaaggctggctgcggcttcaatagtttttaccgccatcagcggagcgggataatgcttgcctgcggtttgcagcaccatggctttcgcgatagtgaaactcatggccgcttcaatcgggctgagtttcagcggagccagcttaggggcccggcgggcgcgccagctgccatcagtggcagcagctttgagcatggtgattcccgcctcacgcagtttctcgcgagacaccaccgcatcgaccagaccgagtttaagagcggcattgccatcgacatcttttcccgccgcaataatttccagcgcactgtcggcgcccagcaggcgcggcaatcgcacgctgccgccaaatcccggcatgatgccgagtttggtttccggcaggccaatacgggcgtccgcagtagcgatacgcagatcggttgccagtacgcattcacatccgccgcccagtgcatagccgtcaatggcggccagagtcggtaccggcaaatcttccagacgattgaagatgctgttggcgtaactcagccactggctcagtttttcggtgggtgcatcaaacagtgaaaggaactcggtgatatctgcccctacaataaatgcaggtttagcggagctcagcagcaggccgcgcagttctggctgctgctccagcacagctattgcctcgcccaggctggcgacagtttgcgtatcgagcttgttgaccgagcccgtagcgtcaaaaaccagctcggcgatgccatcgtccagccagtgaagagtaaggttagcgccttggtagagcatgtgcgtctcctgaaaccgcgaaaggtgatctggtcataccagatgatcgtgagtgtgggagcgatgttaattttttgcaaactggtctttgcttatttgctaacaagatcacagctgcgccgacttcggcatctgcgcaaggggtatgctaaactgcggccatttcgcgacactggagagacgtcaatggattcactgaagaccttgtatcacgcgcacatcgccacgttgcaacaacgggcgcagcaggtgctggcacgcaataaactggatgcgatgttgatccattccggtgagttgttgacggtgtttctggatgatcacacttatccgtttaaggtgaatccgcagttcaaggcctgggtgccggtgacgcaggtgcccaactgctggctctggattgatggggtgaacaaaccgaaactgtggttctactctccggtggattactggcataacgttgaaccgttgccggatagcttctggaccggggatgtcgacgttatcggcctgaaaaatgcggatgagatagcgcagttgctgcctgcacagcgtgataacgtcgcctatatcggcccggttaacgcgcgtgcatctcagctcggcatcgcctctggcaatattaatcccaaagcggtaatcgacttcctgcacttccatcgcagcatcaaaactgattatgaactcgcctgtctgcgccaggcgcagaagctggcggttgccggtcatcgcgcggcgaaagaggcgtttctcggcgggcttaagcgagttcgatatcaatcaggcgtatctgaccgctaccgttcatcgcgacaccgatgtaccttacggcaatatcattgcgctgaatgagcacgctgcggtgctgcactacacccggctggatcatcagccaccggcgaaacgccatagctttttgattgatgcgggtgccgagtatcttggctatgccgctgatttgacccgcagctatgcggcgcagagcagttcgctctatgccagaatggttgaggcgatgaacactgaagagctggccctgatagccacgctgaaaccgggcgtacgctacaccgattaccaccttcagatgcatcagcgtattgcgaagatgttgctgaagtttgagctggttcagggaatcagcgaagaagcgctggtggctgaagatctgaccggtccgtttatgccacatggcctggggcatccgctgggtctgcaggtccatgacgttgccggttttatgcaggatgagcagggcacccatctcgccgcgccagcgcaatatccttatcttcgctgcacccgcgtgctgcaaccgggcatggtattaaccattgagccgggcttctatattattgactcgttactgacgccgctgcgtgaaggccgtttcagtcagcactttaactggcaggccattgatgcgcttcggccttatggcgggattcgtatcgaggataacgtggtgatccatgcgcatcgcgttgagaacatgacccgcgatctgcatctggcctgatggaggcctttgatattcccgctgtgccagtaagcagcagtgaggagacaatcaaaaagagtcgcttcattacgctactggcgcacaccgagggtgcagaggcggcgcgcgcgtttgtccagcaggttaaaagcgagcatcccactgcccggcatcactgctgggcctgggtagcgggcgcgccgaatgattctcagcaactcggtttctctgatgatggtgaaccttcgggtacggcagggaaaccgatgctggcgcaactgatgggcgcggatattggcgagattaccgctgtggtggtgcgttactacggtggcatcatgctgggaaccggcggcttagtgaaagcgtatggtggtggcgtccagcaggggcttaagcagctgccactgcagcgcaaagtgccgatgaagctgttcactttgcaatgtgactatgcacagctcagtgatattgaacggctggtacagcgttttgaaggtaaggtgaccgacagccagtttcaggatcgtattgcattgacgctggctgtaccttacggacagatcgacgggttcaaaaaaaatctgtcagactttagtcggggcgcgttatcgctgatcccgctcacaccatgatgttcatctcttttatttaaaggaacggctgaatgcactttcgcgccattacccgcatagtcggtctgctggtgatcctcttttcagtgacgatgattttgcccggcctggtcgccttaatttatcgcgatggcgcagggcgggcgtttagccagacctttatgatggcgctggtgatcggctcgctgctgtggtggccgaatcgcaaaaagaaaaccgaactcaaaccgcgggaagggtttctgattgtggtcctgttctggacggtgctgggcagcgtaggggcgatgccctttatctttgccgaacagccgcatctttcggtgacggatgcgttctttgaatctttctctggcctgacaaccaccggtgccaccacgctggtggggctggactcgttgcctaaggcgattctcttctatcggcagatgctgcagtggctgggcggtatggggatcatcgtattagccgtggcgatactgccgattctgggcgttgggggcatgcagctctatcgcgctgaaatgccggggccgctgaaagataataaaatgcgaccgcgtatcgccgagacggctaaaacactctggctgatctacgtcctgctgacgatagcctgtgcgctggcattgtggctggcgggaatgccagcgtttgatgctattggccacagtttctcgactatcgccattggcggcttctcaacccatgatgccagtatcggctattttaacagtggcaccatcaataccatcgtggcggtgtttctgctgatctcaggctgtaactacggcctgcactttgccatgttaagcggacgtaatctgcgtgtgtactggcgcgaccctgagttccgcatgtttattggcgttcagctgacgctggtgttgatctgtaccctggtgctctggttccataatgtctatgaaagtggctggcagacgctgaaccaggcctttttccaggtggtctccatggcgacgacggcgggattcacgaccgacagcatcgcacgctggccattgttcctgccggtactgctgttgtgctccgcctttatcggcggctgtgccggttcaaccggcggtggtctgaaggtgattcgcatactgctgttatgcaagcagggtaaccgtgagcttaagcgtctggttcaccccaatgcggtctacaccattaagctgggcaaccgggcgctgccggaacgtatccttgaagctgtatggggattcttctcggcttatgcgctggtgttcctgatcagcatgctggcgatcatcgctaccggtgttgatgacttctcggcttttgctgccgttgccgcgacgctcaataacctcggccctggcttgggggtcgtagctgataacttcacttcaatgaatgacgtggcgaaatggattcttatttccaccatgttgttcgggcgtctcgaggtattcaccttgctggtgctgttcacgcctactttctggcgtgaataattaataaggatgctgacatgaaagcgctgattctctattccactcgcgacggacaaaccaagaagattgcctcttctattgctgatgtgatccgccagcagcagcagtgtgatgtactgaacattcaggatgccactctgcctgactgggcacagtatgatcgtgtgttaattggcgcatctatccgctatggccattttcagccggtcgtcgataagttcgttaaacaacaccttcatgagttgcagcagcgtaccagcggtttcttttcggtgaacctgacggcgcgcaaacctgagaagcgctctcctgaaaccaatgcctatacgcagaagttcctggcacactcgccgtggcagcctgattgctgtgccgtgttcgcaggcgcgctctattacccgcgctatcgctggttcgatcgcgtcatgatccagttgattatgcgcatgaccggtggtgagacagattcgacgaaagaagtggagtatacggactggcagcaggtaagcacttttgccaatgattttgcacagttaccaggcaaatcgtagcgaaatagcgcgatttgatgaaaattactgcgaacgataatcttttcgtaataaacacttgtcagcccgcgcgaactccctataatgcgcctccatcgacacggaacaccggcaacgggatgacaggttgagaggcacaggagactgcgccgccggagaaaaacttctgagaaagaggttgactctgcaggaggaaagcgtaatatacgccacctcgcgacaggacgctaacgcactgttcgcactgctctttaacaatttatcagacaatctgtgtgggcactcgcaggattgatatcagcgtctccggacgtaaaaaaatatcaagcctcacgagtgaacacataatgaaattcattatgacgttttacagatgagcaccgcttaacttgtttaagcaaatcaaacttaaattgaagagtttgatcatggctcagattgaacgctggcggcaggcctaacacatgcaagtcggacggtagcacagaggagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccctgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaacttagcagagatgctttggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaagataccttcccgcgcagtgtccacacagattgtctgataaaaagtaacgagcagaaaaaacctctacaggcttgtagctcaggtggttagagcgcacccctgataagggtgaggtcggtggttcaagtccactcaggcctaccaaattcgcactcacgctgcgttatgtctccggctcgcatagttcactatgcttcgcggaaacatgccttgcctgagcacgaattacatttctcacgaagtgtactcggttgagtggtagtagtggtctctgcagtaactgtatggggctatagctcagctgggagagcgcctgccttgcacgcaggaggtcagcggttcgatcccgcttagctccaccataccgtttatctgttttttctgaaatacctcagagcataccggcgacggtgtgctgcgacgtattatgctctttaacaatccggaacaagctgaaaattgaaacgacgcagcgcgtcattcctccgtaataagggatgacaaggcgatgcgttcgagtctctcaaatgcttgcaattcgcagcgttgtaaaacgcctgtgggttgtgaggttaagcgactaagcgtacacggtggatgcccaggcagtcagaggcgatgaaggacgtgctaatctgcgtaaagcgacggtaaggtgatatgaaccgctacagccgtcgatgtccgaatggggaaacccggtgcactctgtgcatcattgcagcatgaatacatagtgctgcaaggcgaaccgggggaactgaaacatctaagtaccccgaggaaaagaaatcaaccgagattcccccagtagcggcgagcgaacggggagcagcccagagcctgaatcagtttgtgtgttagtggaagcgtctggaaagtcgcagggtacagggtgatactcccgtacacaaaagcacacaagctgtgagctcgatgagtaaggcgggacacgtggtatcctgtctgaatatggggggaccatcctccaaggctaaatactcctgactgaccgatagtgaaccagtaccgtgagggaaaggcgaaaagaaccccggcgaggggagtgaaacagaacctgaaaccgtgtacgtacaagcagtgggagccttctttatgggggtgactgcgtaccttttgtataatgggtcagcgacttatattctgtagcaaggttaaccgtataggggagccgcagggaaaccgagtcttaactgggcgttaagttgcagggtatagacccgaaacccggtgatctagccatgggcaggttgaaggttgggtaacactaactggaggaccgaaccgactaatgttgaaaaattagcggatgacctgtggctgggggtgaaaggccaatcaaaccgggagatagctggttctccccgaaagctatttaggtagcgcctcgtgaactcatcttcgggggtagagcactgtttcggctagggggccatcccggcttaccaacccgatgcaaactgcgaataccgaagaatgttatcacgggagacacacggcgggtgctaacgtccgtcgtgaagagggaaacaacccagaccgccagctaaggtcccaaagtcatggttaagtgggaaacgatgtgggaaggcacagacagccaggatgttggcttagaagcagccatcatttaaagaaagcgtaatagctcactggtcgagtcggcctgcgcggaagatgtaacggggctaaaccatgcaccgaagctgcggcagcgacgcttatgcgttgttgggtaggggagcgttctgtaagccgtcgaaggtgtgctgtgaggcatgctggaggtatcagaagtgcgaatgctgacataagtaacgataaagcgggtgaaaagcccgctcgccggaagaccaagggttcctgttcaacgttaatcggagcagggtgagtcgacccctaaggcgaggccgaaaggcgtagtcgatgggaaacaggttaatattcctgtactcggtgttactgcgaaggggggacggagaaggctatatcagccgggcgacggttgtcccggtttaagcgtgtaggcggagtgtccaggtaaatccggacgcttgttaacgctgaggcgtgacgacgaggcactacggtgctgaagtgataaatgcccagcttccaggaaaagcctctaagcatcaggtaacacagaatcgtaccccaaaccgacacaggtggtcaggtagagaataccaaggcgcttgagagaactcgggtgaaggaactaggcaaaatggtgccgtaacttcgggagaaggcacgctggcgcgtaggtggagggacctgctccccgagccgaagccagtcgaagataccagctggctgcaactgtttattaaaaacacagcactgtgcaaacacgaaagtggacgtatacggtgtgacgcctgcccggtgccggaaggttaattgatggggttatccgtaaggagaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactacagcttgacactgaacattgagccttgatgtgtaggataggtgggaggctttgaagcgcggacgccagtctgcgtggagccaaccttgaaataccaccctttaatgtttgatgttctaacgtaggcccgtaatccgggctgcggacagtgtctggtgggtagtttgactggggcggtctcctcctaaagagtaacggaggagcacgaaggtcagctaatcacggtcggacatcgtgaggttagtgcaatggcataagctggcttgactgcgagagtgacggctcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgctggagaattgaggggggttgctcctagtacgagaggaccggagtgaacgcaccactggtgttcgggttgtcatgccaatggcattgcccggtagctaagtgcggaaaagataagtgctgaaagcatctaagcacgaaacttgccccgagatgagttctccctgactccttgagagtcctgaagggacgttgaagactacgacgttgataggccgggtgtgtaagcgcagcgatgcgttgagctaaccggtactaatgacccgtgaggcttaaccttacaacgccagaggcgtttttgagagacagattttcagcttgttcaccggatacagttgtgtcctgcggactgaagtccgaaggattttgcgctgaggcaaggcggcaaccgagcgatacgaaggagcatactgaagtatgtgacggagtagcgcgagggcggccaacgcagcatcagcacaaaagacacaggacagagcacaaagaatttgcctggcggctttagcgcggtggtcccacctgaccccatgccgaaactcagaagtgaaacgccgtagcgccgatggtagtgtggggtctccccatgcgagagtagggaactgccaggcattaaataagtgaagaagccccgcacgaaagtgcggggcttttttacgtctgcgctttgccacgttaagctgaaacattttcattttctgcatcaaacctcgacatcttacaacgaacaggctaatgttgggcatctggatgtctaaacgtttatatggttgtaagaggtgagcaggttatgccaatcagggttcccgacgaattaccggcagtgaattttttgcgtgacgaaaatgtctttgtgatgacatcgtcgcgcgccagtgttcaggagatccgcccgcttaaagtgctcatactgaatctgatgccgaaaaagatcgaaacggagaatcagtttctgcgtctgctttccaactcgcccttacagatcgatattcagctgctgcgcatcgacagccgcgagtcacgcaatacgcccactgagcacctcaacaacttctactgcaattttgaagatatccagcatgataactacgatggcttaatcgtgacaggtgcaccactcgggctggttgattttaatgatgtcgcttactggccacagattcagcgcgttctgcactgggccaatgagcatgtcacctcaaccctgtttgtctgttgggcggttcaggccgcgcttaacattctgtatggtatccccaagcaaacccggcataacaaactgtctggcgtctatgaacatcagatactgcatccccatgcgttactgacccgcggttttgatgataatttcctcgcaccgcactcacgctatgctgattttcccactcatttgataacggattacaccgatcttgaactgtttgctgaatcggaacaaaccggtgcctatctgatggcgagtaaagacaaacgtctggtgtttgttaccggtcacccggaatatgatgccctgacgttgtctggtgagtaccatcgcgattatgaagcgggggtgaatccggaagtcccttataactatttcccgcaggataatccggtattgccaccccgcgccacctggcgcagtcacggcaatctgctgttctcgaactggctcaactactacgtttaccagatcacgccgttcgatctgcgtcacatgaacccaacgctggaatagtcctgtctgaagatcaactgaaccgtgttagccgatggcaacacggttttttatcgcctttaaaacgttaaatgaaagcgattcctttaatggattaaagttttatttcatataaaacatcaggataggttaatttatatttaaaaatggaaatagtttttgatttaaaaaaataaatgcttatgctctgatcctgtagctcacaaaataaacaccgtgtggatccgctgctttcgatcctttgaatacaggagaacgccagcatgacagactcagtgatcagccataccctgattttcagccagccctttagccatgcagaaacagcaactgttaacgcccgaggctgtttcttttttagagtctctggtcgcacgctttgcaccgcaacgcgaagagctgttatcggctcgccagcagcgtcagcagcaatatgaccagggctatctgccagacttcgatatggaaacggcttccataagagccagtgaatggcgtattcaatctattccggcagatttagaagatcgtcgggtcgagatcaccggtccacccgatcggaaaatggtgattaacgccctgaactcaaacgttaaagtctttatggccgactttgaggattcgctgtctccggagtggtcaacgttgattgaagggcagctgacactgcgcgaagcagtacagggcaccctgagttataccagcgacaaaggcaaaatttatcagctcggcgctacccctgcggtactgatgtgccgggtgcgcggtctgcatctgtcagaaaaacatgtcagctggcagggaaaggcaattccgggcgggctgtttgatttcgcgctctatttcttccacaacgtccggccgttactggccaaaggcagcgggccttatttctatctgccgaaaaccgagagctggcaggagatcgcctggtggcgtgagatcttcagtttcagcgaggatcagttcgatctgccgcgtggcacgatcaaagccactgtcctgatcgaaaccttacccgccgtgtttcagatggatgagatcctgtggaatctgcgcgatcacattgttggcctcaactgtggccgctgggattacatcttcagctatatcaaaacccttaaacagcatgcggatcgcgtgctgccggatcgccagtccgtcaccatgtctcagccgttcctggacgcttattcgcgactgctgattaaaacctgtcatcggcggggggcttttgcgatgggcgggatgtcagcgctgatccccgctaaagatcccacgcgcaatgcctgggtactgcagcgcgtgacggaagataagcagcgggaggcaggtaacgggcatgacggcacctggattgctcatcctggtctggcagagaccgcgatggcggtcttcaacgctgcgctgggcgaccggccaaaccagctgcaggtcatgcgggaagaggatgcgccgatcacagcggagcagttgctggcgccctgtcagggtgagcgcaccgaagccggtatgcgcgccaacatccgtgttgcgctgcaataccttgaggcgtggatcagcggtaacggctgtgtcccgattgacggactgatggaggatgccgccaccgctgagatcgcacgcacctcaatctggcaatggattcgtcatcagcaaatgctgaacaacggccagcaggtcacagctgaactgtttctgcgctggcttaacgaagagctgcatctgctgcaaaacgcgctgggcgaagcccacttcagcgccggtcgctatgacgacgcggcgcagctgatggctcagatcaccaccgagcgcgagctggtttcctttcttaccctgccaggctatcgcctgatcccctgaacagaggagctattgccatgacacgtactcaacaaatcgatcaactggaacaactctggcagaccactcgctggcagggcattacccgcccttacagcgcagcagaggtcgtcaatctgcgcggctcggtcctgcccgcctgtacgctggcagagcgcggtgcggaaaaattatgggcgttgctgaatggcgaggcgaagaaagggtatatcaatagcctgggtgcgctgagcggcgggcaggcactgcagcaggccaaagcgggcatcgaagcgatctacctttctggctggcaggtagcggcggatgccaacgtggcggggcagatgtatcccgatcagtccctctacccggtgaactcggtgccggaagtggtgacgcgcattaatcagacctttcagcgcgccgatcagattcagtggtccagcggcattgaagcgggagacagccggcacaccgatttcttcctgccaattgtggccgatgctgaagccggttttggcggcgtgctgaatgcgtatgagctgatgaaggcgatgattcaggcgggcgcggcggcggtccacttcgaagatcagctggcagcggtaaaaaaatgcggtcacatgggcggcaaagttctggtaccgactcaggaagccattcagaaactggtggcggcacggctggctgccgatgtgatgggcgtgccaaccgtgctgctggcacgtactgatgccgacgccgccgatctgattacctcagactgcgatgaatacgatcgtccctttatccagggcgaccggacggcagaaggcttcttccgcacccacgccggcattgaacaggcgatcagtcgcgggctggcctatgcaccttatgctgacatcctgtggtgtgaaacctcaacgccggatctggcgatggcgcagcgctttgccgacgccattcatgcccgtttccccggcaagctgctggcctacaactgttcaccgtcgttcaactggaagaagaacctcgacgaccgcaccatcgcgaagtttcagcaggcgctcagcgacatgggctatcgcttccagttcatcacgctggcgggcatccacagcatgtggttcaacatgtttgatctggcccacgcctacgcccagggcgaagggatgcgtcactatgttgaaaaggttcagcagcctgagtttcgctgcccgcgatcgcggttacagcttctcttcgcatcagcaggaggtgggcaccggctattttgatcaggtgactaatatcattcagggcggtaagtcctcggttaccgcgctcaccggttcgaccgaagagcatcagttctgacccttttcctctgactgatttcccgtccgcaaaccgcgggcgggcgtttaccggagctgattatgccgccacgcgaatcattgatcgcccacactatcctgcagggttttgatgcacagtatggtcgctttctcgacatcactgctggcgcacagcagcggtttgagcaggcggaatggcaggcggtgcaacatgccatgaaggcccgtattcatctctatgaccatcacgtcagcctggttgccgatcaactgcgggtgttgagcggtgcggccagctgggatgagatgttctggctgcgggttaaggaccactatcaaagcctgctgcccggctatccacggcatgaaattgccgaaagcttctttaattctgtctactgccggttacatggacatgccgatctgcagcctgaccggctgtttatcttcagctctcaatccctgaccgcaccggtcacacctttgcgcccgttatcgcgccgttatcagccggagcggggctggctggcactggtggatcaggtgttgagcgatttaccgctgacgttgccgtggcagcagcgcgctcgcgacgtcggctggattgtccgccacctgcagtcgcattttccccggctgaaccagggctggctcgaggttaacagtgaactcttctatcgtaacaaaaccgcctggctggtggcgcggctgcatctgccggaaggcatcttgccctgtctgctgccgatccagcgcagtgaaacgggcgaactgtggatcgacacctgtctgaccgatgtgaatgacgccagcattgtctttggttttgcccgcgcctatttcatggtttatgcgccggtgcctgcggcgctggtcgcctggctgcaaccgattctgcctggcaaaaccctggcggagcgctatatggcgattggctgccagaagcacggtaaaaccgagagctatcgcgagtatcttcaggcgctggcagagaatgagacggcctttgagatcgcacccggcgtgcgcggcatggtgatgctggtcttcacgctgccgggctttgactgggtgttcaaggtcatcagggatcgcttcgcgccgcaaaaagaggtgacggaagcgcaggtccgcgcctgttatcagcaggtcaaagagcacgatcgcgtgggacgtatggcagatacgcaggagttcgagcagtttgcgctgccgctgtcgcgtatctcaccggcgctgctggcagaaaactccacgcctgcgtggctgagaagctgcatatcgaaggcgatcgcctgattattcgtcacctgtggctggagcgccgtatgcagccgcttaatctctacctggcccaggcgaatgccgcagagcgacgtcacgcgattgaagaatatggcaatgccatccgacagctggcggcggccaatatctttcccggagacatgctgtttaaaaacttcggcatcacgcgccatggccgggtgattttttacgattacgatgagattcgcccgatgcaggagctgcacttccgggatgtgcccgcggcgcgctatgaggaggatgaactcagcgccgagccctggtacagcgtcgggccggacgatgtcttcccggaaaccttccgctatgcgttatgcagtgaagccgctaccggcgcattgctgttgcaactgcatccggagatattcgacgcccgctggtggcgcgcgcagcagcagcgcatcgcccagggtcatgtggaagaggtgatcgcctggcggcagacgcagcgtttcagcgtctgctacggcgcagataaagttaacgaccgctgtacgccagcgtaacctggcgcgcttcgcggatgaccagtgcacctaattcagtaatccgatcgtcagtcatgcgggcgatggggccggagatggagagcgcggcaaacgcctcgccatgttcgtcatagattggcgcggcgacacagcgtagtccaagcgcatgctcttcatcatcaaatgagaagcccgctttgcgcaccagcgccagattctctttcagactctgcggcgacatcagggttttcggcgtgtagtaatgcaatcctttctgatgcagcagggcggtgacctgctcatcgcccagatgggccagaaacgctttgcctgcgccagacgcatgcatcggcagcttgccgccaatcggcgcggacattcgcatcagctgggtacactgcacctgatcaatgatcaccgcctggtgatcgctgagatccagcaccgccagattcaccgtttcaccggactgctccatcaggctacgcagcaccgggtgtaccagcgccagcaggttacggctctgcaggaaactgctgccgaccacgaaggcgtgtgcgccgatcgtccacagcccgagatcgcccacctgccggacaaaaccctgctgttgcatggtgctgagcaggcgatgcgtggtggagttaggcaaacccgcctgctgagccagctcggtcagcgctacgctgccatgtgagtcagcaatcagctccagcagcgtcaggccgcgggtcagcgattgcacctgacctcccgcgggtgcggcgacaggggtgccacggggtttcttgccgcgcttaacaggaaccggggttgccatcattgttctccttttacattgtggaaatcattttcgttttaatcgcgcgctttgcaaacgctggttttctggtcagacctgtacagccgtgacctgaaaatctctcagtcgaggttactttgtcgcctgaccagcttgtgccagaatgaaaaacgggcttttccgccagcagactgacgtgaatggggcaacagtgagcaataaaatcgacgcgttaaaacagcagctcgcacaacgcattatggtgctggatggggggatgggcaccatgatccagagctataagctggaagaagaggattatcgcggcagccgttttgctgactggccttgcgatctcaaaggcaataacgatctgctggtgctgagtaaaccggcggtgatccgcgagatccacgacgcctatctggcggcgggtgcggatatcctcgaaaccaacacctttaacgccacgtcgattgcgatggcggactaccagatggaacgtttatcggcggagatcaattttgaagcggcccgcctggcgcgagcctgcgccgatgcgtggacggcgaaaacgccggatcgtccgcgttatgttgcgggtgtgctcggcccgaccaaccgcacctgctcgatctcacccgacgtcaacgatcctgcctaccgtaacgttacttttaatcagctggtggaggcgtaccgcgaatcgacccgcgcgctggtggagggcgggtccgacatcatcatgattgaaacggtgttcgatacgctgaatgccaaagcagccgtctatgcggtgcagaccgagatggaagcgctgggcgttgcgctgccgctgatgatctccggcactatcaccgacgcctccggccgaacgctctccggccagaccaccgaagctttttacaactcgctgcgtcacgccgaaccgctctcttttggcctgaactgcgcgctgggacccgacgaaacttcgtcagtatgtggcggaactgtcgcgcatcgctgaaggctacgtgaccgcccatcccaacgccggtctgcccaatgcctttggcgaatacgatctggatgcggaactgatggcgcagcagattggtgaatgggccaccgccggattcctgaacattatcggcggctgctgtggcaccacaccgcaacatatcgctgccatggtggcggcggttgaaggcgttgcaccgcgtcagttgccgacgatcccggtggcctgccgtctctccggtctggagccgcttaacatcaccgcagagtcactgtttgttaacgtcggtgagcgcaccaacgtcaccggctcggcaaaatttaaacggctgatcaaagaagagaagtataacgaagcgctggaagtggcgctgcagcaggtgcagagcggcgcgcagatcatcgatatcaacatggatgaaggcatgctcgacgccgaggcggcgatggtacgctttctgaatctgattgctggcgaacccgatattgcccgcgtgccgatcatgatcgactcctcaaaatgggaggtgattgagaaagggttgcagtgcattcagggcaaagggatcgtgaactcaatttcgatgaaagagggtgaagcggcctttatccatcatgcccgtcaggtccggcgttacggcgcggcgatggtggtcatggcgtttgacgaagtgggtcaggcggatacccgcgcccgtaaaattgagatctgccgccgtgcttaccggatcctcaccgaacaggtcggtttcccgccggaagatattatcttcgaccccaacatctttgcggtcgccaccggcatcgacgaacacaacaactacgccatggatttcattggtgcctgcgaagatatcaagcgcgagctgccccatgcgatgatctccggcggcgtctccaacgtatcgttttcattccgtggcaacgatccggtgcgtgaagcgatacatgccgtctttctctattacgccatccgtaaaggcatggatatgggcatcgtcaacgcaggccagctggcgatttatgatgatttgccggcagaactgcgcgaggcggtagaggatgtgattcttaaccggcgggatgatggcaccgagcggctgctggcgctggcggagaaataccgtggcggcaaaagcgatggctcgcaggaaaaacagctcgcggaatggcgcagctgggacgtggtgaaacggctggagtattcgctggtcaaggggatcaccgagtttattgagcaggataccgaagaggcgcgccagcaggtaccacggccgatagaggtgattgaaggcccgctgatgtccggcatgaacgtcgtcggtgacctgttcggtgagggcaagatgttcctgccgcaggtggtgaaatcggcgcgcgtgatgaagcaggcggtggcgtatctggagccctttatcgaagccagtaaagaagcggggcgcagcaacggtaaaatcgtgctggccacggtcaaaggcgacgtgcacgacatcggcaaaaacattgtcggcgtggtgctgcagtgtaataactacgaaatcattgaccttggcgtgatggtgccgggcgaaaaaattcttaaaacggcgcgcgaagtgaatgcggacatcatcggcttatcaggcctgattacgccgtcgctggatgagatggtcaacatggcgaaagagatggagcgtcagggctttaccttaccgctgctgattggcggcgcgaccacctcgaaggcgcataccgctgtcaaaattgagcagcattacagcggcccgacggtctacgtgcagaaacgcctcacgtaccgttggcgtggtgtcgtcgctgctctccgccaccttaaaagaggatttcgtcgcccgaacccgcaaagagtacgagaccgtgcgcattcagcatgcacgcaaaaagccgcgcacgccgccggtctcgctgcaggcggcgcgcgataacgccacctcaattgactgggagagttacacgccacccgtgccgcatcgtcccggggtcagtcaggtggaggccagcattgaaacgctgcgcaactacatcgactggacgccattctttatgacctggtcgctggcgggcaaatatccccgcatcatggaggatgaggtggtgggtgaagaggcgcagcgtctgtttgccgatgccaatgcgatgctcgacaaattaagccagcagtcgctgctgaagccacgtggcgtggtcggtatttttccggctaaccgggtcggcgatgatattcatctctacagtgatgagcggcgtgatgagattttgtgtgtgagtcatcacttacgccagcagaccgaaaaaaccgacttcgccaactactgtctggcggattttgtggccccgaaatcgagcggcaaagcggactatctcggtgctttcgcggtgaccggcgggctggaagaggatgcgctggcggaggcgtacgatcgtcagcatgacgactacaacaagatcatggtgaaagcgctggctgaccgtctggcggaagcctttgccgaatacctgcacgagcgggtacgtaaggtgatctggggcttcgcgcccaacgaaaatctcagcaatgaagagctgattcgggaaaattatcaggggatacgtccggcgccaggctatccggcctgcccggagcacactgagaaagccgccatctggcgtctgctggcggtggaagaacagaccggcatgaagctcaccgaatcctttgccatgtggccgggcgcgtcagtctctggctggtacttcagccatcctgacagccgctatttcgccgtggcgcagatccagcgtgaccaggtggaagattatgcggcacgcaaagggatgtcggtcatggaagtggagcgctggctggcgccgaatctcggctacgacgcggactaaataaaaaagcggcctgagggccgcttcagactgctgacaaatccagctccggttaaatctggcagcaataatgaagaaactcaacgcgcagggaacccggtcagaggaggaaagcgtcccgcgccagggacggcgcgggccgagcggccagggatggcattagcgcctttccgatctgaccgggttccctgagcaggcgcgatctcattgctatgctttgcttcaggtgtatgctccctgagcctgctttctgttaaccgcatgaaacggccctgaggccgccatctgcttagttaaagcgcgcgtcgcgatcggacgtcagatcatacagctggtacttgcgacccagcatctgaccgccatcacgcgtcagcggcacccagttcacctgcgcgcgaccgcgcgttggcgtcacagtgaacagatccattgggatggagatatagaagcctttggtgaagtcgccttcgccatactcttcagacgagacgttggttttggtggcatagacacccaccatcacgccgctgtcgaagcgcttcgacacatcgaccgtcacacctttatctttcgccagatactgaccgacgctggttttcaccagtacatcctgcatgaaccatggacgccagtaacccgtcaggttgccggttgaggctttgtagcgattgaactgcatcatgttgtcccagtcacgctgacggacatagttggcatcgacgcccaccgcccagtttcgcatcgaccggacgatagagcagctcgccacccacgccgccatacatcgtctccaggtacccgccgtaaacctgaccatagaagccgttaccgaggtggcccatatagtttgcctgcagatcgttaacgtagacgttgttctcaacgtagtcgcggatatgggtacgcacgcgcggcagcgaagagtccgccggtgcgccgttgtagttgaacttgtcgtagttgttggcgaggttaccaaacagactaccgcccaccagcaagtgatccgtcagccagtaatcagcgttagccattacgccgacctgatacatatagaagctttccgggccgcccaccgactgattcagcacgggtgagaggctgtagttcaggcgatcctgacggataaacataccctgctcggtgctacccggatcgaccggttctttgcgggtctgttgcagtggctgctcatggcccagcggatagccttccagattgttacgcaggctggcgacctgcgtctcagtcgtcacctgtggcatgttaaagcgcgactcggtgacattgatggtgtcgatgccgtcaggcaggtggttcatgatgatgcggttcgcacgatccaccccttcacgggtatcgcgatacttcgtctgctcgcctgacacatagatcgtgtgaccctgagtctgaatacgcggaccatcaagaccggcattgtatttcagatcggtcagctgagtgcccaccaccgtcggctccagcaacttaggttgcggctgcggattgtaggaaggcttctcgctgtcgatgtgcgcctgacgcagatcgttgaagttggtgcgaatggtgacaccaaacataaaggtgttaccgcgttcgtagctggcgttgatgtcagcccagtcggtcacgcgataaatcgcgccgacgttgagcttgctgcgctgctcaaggcggccagcaaagtcattctggtagtcgttgccctcatactccattttaaggcgcagcggctgccagggcgtctgatactccacgccgccaaacagcgccgtcggaccgtggaacatctgcgagccgttgattgaacccgcttcgcccacctgcggacgctggcaatagctgtcgctgtatgagcagaaacgggttcttcacggtgccgctattgccgagatagccccagccaagccccagggtaaagtcgaacggtccccatgctttggtcgccaccaggtattcactgtcgaacagaccggtaccgcccagatcgcgggttcccaccgccacttccggcagccagaagccctcctgccacagacggagtttcaggtcgaaggctttatctttatagctctgcgtgccgctgaattctgagaccgcactgtactgacgggtgcgcacgtcggtataccgcacagtggtctccagccagggaaagagctgcagtgacgcggagtagtatcggtactgatcgttgtcgcgcgcgttgaggctgaactcgccctctttggccatgcgcgccgtcggcacctgcatcagacccacgccgccgaaatcggattgtgaagggcccaccggctcgggccaggtgtcagcctgcgcctgacaggctgctgccactgaaacagccaacaggctgaagagataacgttttttcatcagtctggtatccggtgagtcagtacggaaaggatgcgttcattaaggtcttcatagctgcctggcaggctccatgacgaaaagccgagccagataatgctacctggctccacttccgcgtggcgatgattccagtaggcaaccggcacctgctgtgtggcgcctgaaggtgcaatcacggtgacaaaattgcgttctgccccggagagtgcgtcatgaccatccagatagtcgcgtactgatttacccggctgccagctcactttgcctgcgccgctctgcgcgccgagcagcagtacagaatctgagggagcctgcagatagaggtcatagctgccttccagccgacggttgtcagccgtatgcagacggatccagtccgggtcgagcgacgtgaactggcgacctgctactttgatggcgctcagctggcggatcacctcatcaatggccgccgcccgatcgccgctgctgtcggcacgccaggcacgtaacgcacccagcgtctgttgatagtgctgctgtgccactgcgctggcgccgcgctcggcaataaaggtcgcacgccagtcagtgttgacctgcagtggaggcagagtcaccagctgggagagatccgcgacctggctcagctcagcctgaccgccgttgtgcggtgcatgaacgataacctgcgcagttgcctgcgcttctgcggcgctgaacaggctcagcccggccagcaaaaaagtgatttttttcatgatttcgccggcttcagaatagtgatatctacagggaaggcgtctgccgccagcatctgatgggcctgcaccacatcgccgctgctgttatcgatccagaaggtgttttcccactcgcggttactgctgtcgatgctcacctgctcatgccagacgcggcacggaatgcggttgcccgccacgatcaggacttcgtcggtgccgcgctggaaggttgaacgcacagtcgcgccgcgaaccttgccctgttcggtccactgcacgatgcgggtccagcctgcgccgttgctgatatgcaggctgtcagcgagcggatcctgttgcagattgctgacgctcagcaggttatccggcaagcccagggttttaaccaggcggccatgctgtgtcaccagcatcgcctgatcctgtgtcacccatttttgctgacctttctcgttgtagccgagcactacaaaaatgcgcggaccttcattcaggcgagcatagagactggcatagggaagattgttgacctgttgatcggtaacggtcacgtcgtccggaccgttaaccgcaagcagcagagtctgttcaagacctttttgcgtttgtgtacaggcctgcagcagcaggcaagcgagcagcagaggaagttggcgcactgtgtgtccctgataagtcatgccaaagtaaaaaataaccacacaggcgtgtggttatgtttaaaggtgctctgcccgtcccgtttccggctgcagaaatacaggttacgtggctcagcgtcctcactcaccgaagtcagtggttcagcctctgcccgtttgctgtagatcagcaatcagacggggtcgggcatccatcaacgagtggtgctcgtcgtggtcgtggttgttgtaccggtatttgcaccgtcaccaccgccagaagcggcaatgccgagcccgaccagcgcgccaagtgcaccgatacccacagcggtcgacgtgccagcagagattgctcccgcctgcgcgccagctgcggtaccagcttcttccggcgcagcaaatgcgctggaagagacggcaacgaagatcaaggctgcaccggcaaccatagtttttttcataacagcgtttcctgcattgagtgaatgaaggatctctgtccgctgaggttgcaacgcagtcagactgcggcaaaatcgacagacagtcccattgcgggcgcgttcagtatagggcaacaaaataccagagttcagcaccggaaaaaccagggtgaatagcggggtgggcgcgtgatttaattagctggattggggataactactttttatatcggaatatttcgggctgatgccagatatttcgctgctggcgaatcaattgcaaagcgtaatgttcttttttattaatatctggtacggaataagaataatcagaatttactcaggattgctgaaactgaatatgattatgaatcaatagctaacaatagagattacccgatttcaggaccattttatactttatgctggcccgttcagcgcatcgatgttcagaattatcttaggttattttaagacttttccctgacaacccatgctctccaacgatataaacagcccattcagatgtaaaaacagtcaaaaaaagggcggcaaagtggccgcccgatgaaattaacgccgattaacgccaggatttatagcggttaattaaggcattagtggagctgtcgtgagtggtaacttcgtcctcgttttccagttccggcagaatacggttcgccagctgcttacctaattccacaccccactgatcgaaagtgaagatattcaggatggcaccctgagtgaagattttgtgctcatacagggcaatcagcgcgcccaggctgtaaggggtaatctcacgcagcaggatggagttagtcgggcggttaccttcaaacaccttgaacggcacgatatgggctacagactctgcagatttaccggcatcggtaaactctttctctacgacgtcgcgtgacttaccaaacgccagcgcttcagtctgggcaaagaagttagagagcagcttcggatggtgatccgcgagcgcattatgggtaatggccggcgcaataaagtcgcacggaaccagcttggtaccctggtggatcagctgataaaacgcgtgctgaccgttggtgccaggttcgccccagatgattgggccagtctggtagtccaccggatgaccggcacgatccacatacttgccgtttgactccatattgccctgctggaaataggcggcaaagcggtgcatgtactggtcgtaaggcagaatcgcttcggtttcagcaccaaagaaattgttgtaccagatgccaatcagtgccagcagcaccggcaggtttctgctcagccggcgcagaggcgaagtgctggtccatggcatgtgcgccgctcagcagctgctcgaagttatcgaaaccaatcgagagaatgatcgacaggccgatcgctgaccacagtgaatagcggccgccaacccagtcccagaattcaaacatgttgttggtgtcgataccaaattcgcccaccgctttggcgttggtcgacagcgcagcaaagtgtttcgctacgtgctgctggtcgcctgccgttttcaggaaccagtcgcgcgcgctgtgggcgttggtcatggtttcctgggtggtgaaggttttcgatgccaccaggaacagggtggtttccgggctgaggtctttcagcgtttcggcgatgtgggtgccgtcaacgttagagacaaaatgcatgttcagatggtttttgtacgggcgcagcgcttcagtcaccataaacgggccgaggtcagagccgccgataccgatattcaccacgtcggtgatcgctttaccggtatagcctttccattcgccgctgatgatgcgctcagagaagcctttcatcttatccagcaccgcgttgacctctggcatcacatctttgccatccaccagaatcggcgtgttactgcggttacgcagcgcgacgtgcagcaccgcacgatcttcggtgcggttaatcttctcacccgagaacatagacttaatggcaccgctcaggtcggtctctttggccagcgcctgtaacttatcgagggtttcctgggtgatgcggtttttggagaaatccaccagcatctgatcatcaaaggtggcagagaatttggcaaaacgatcggcatcctgggcgaacagatcggcaatttctaccgacttcatctgctcaaaatgctgttgcagcgctttccaggctgcggtttgtgtcggattgatatttttcatggcaacactcttgttgatattaagaaccgtcattccatcggaggcacatcatgcccgtttagcgtttcagtatgaccacagttgtaactgaaaggaaaaattttgtcagcgcgcgccggacaggcgatctgaacgccgctgtttatcgccagcattcactggcgcgaacagccagcggaccgcagaggcaacgcgcggtaaagtgtgacgcgaaagtctgcgcaaaacgttgtgccgtatcagggattgctgcatgggctgaacccattaagcactgtagccgctgcgacgcagagccatttgttttctgatgcggcgctccgggcatcgctgacattgacagcaggtccagaaaaggctagatctatgcgcctacttgcgcacctgtgcgcaagccagaagaggcgcgtcgcccaggcagtgtgttggaggaaccgtatccggtgaaaacacatgatggggagcgacgccgaggtgggtcagcacgcggtgtgctgcctgtcggctacaggggctgaatcctctgggttgtcaccagaaacgtctgcagtcgacgtttcgcaaggtggggcgcttctgggtgactcgtctatccgatcttgtccgcccgtttctgctctttccttgtgcctggctgaaagaatgtttctcgaccctttcatcggcgagaacaagataacctgacacgaggtcctacatgtctcaaacactgatagtggcaaaattcggcggcaccagcgtagccgattttgaagcgatgaaccgcagcgccgatgtggtgttgcaggacgccagcacgcgtctggtggtgctctctgcttcggcgggcattactaatctgctggttgcgctggctgaaggccagcaggctccccagcgcgctgtgctgcttgatgatatccgccgtatccagtacgccattgttgatcgactgcagcgtccggaagtgatccgcgatgaaattgatcggatgatcgacaatatcagcatgctttccgaagccgcctcactggccacctcgaatgccctgaccgatgaactggtcagccacggcgagctgatgtcatcactgctgtttgtggaaattctgcgtgaacgccaggttaatgcggagtggttcgatgtccgcaaggtaatgcgtaccgacgatcattttggccgggcagtaccggatgtacaggtgctggcggagcaggcgacggcgcagttacagccgcgcattgagcaggcattagtcattactcagggtttcatcggcagtgaaagcgaagggcgcaccaccaccctcggtcgcggcggcagtgattacaccgccgcgctgctgggcgaagcgctgaacgcggcgcgtgtggatatctggacggatgtgccgggcatctacaccaccgacccgcgcgtggtgccgacggcgaagcgtattgatgaaatcacttttgaagaagccgctgaaatggcgacgtttcggtgcgaaagtgctgcacccggcgacgctgcttcccgctgtacgccggggtattccggtattcgtcggttccagtaaggatccggcagccggtgggacccgcgtctgcaatgaaacccgcaacccgccgctgtttcgggcgcttgcgctacgccgtaagcagacgctgttaacgctgcacagccttaacatgctgcatacgtttggtttccttgccgaactcttcaatattctggcgcgtcataacgtctcggttgacctaatcaccacctccgaagtgagcgtggcgctgacgctcgacaccaccggttcgacctcaaccagtgccagcctgctaacccaggctttactgactgaactctcgtcgctgtgccgggttgaagtggaagaagatctggcgctggtggcgattatcggtaaccagctgtcaaaagcgtgcggcgttggcaaagaggtgtttggtgtgctcgacccgttcaacctgcggatgatttgctacggtgccagcagctacaatctctgcttcctggtgccgggcaacgatgcggaaagcgtggtacgtacgctgcatcgcaatctgttcgagtaggcttctgtggcattcaggccgcgtcagcgcggcctgaaaagcggcaaaaaaggttcatatctccctcattactccccggcacgcgacttccgataaatcccattaatacagaaagttacagcctgttattgccaaatggcaatccctttctctgcgcatttcgtgcacctgcattgcgctccctttccgcagatttataatcccgccgctgaatcaattcacccaaatttaggaaatatcatgaaaaggttagtcgcagaggcgctgggtaccttcgtactggtggccggcggttgtggtagtgccgtgctgtcagctgcgtttcccggagctgggcattggcttcatgggcgtggcgctggctttcgggctgagcgtgctggtcatggcgtatgcggtcggtcacatctcaggcgggcactttaacccggcggtgaccctgggattagtggcaggcggacgttttcccgcgtctcaggctatcccttacatcatcgcgcaactggctggcggcattgccgctggcgcggtgctctatctgatcgccagcggtaaaggcgacttcagtgcagcggccagcggctttgcggcgaatggctacggtgaacactcgccgggcggcttcagcctgcagtcaggtatgatcgccgaaggggtgatgaccgctatcttcctgattgtgatcatgggtgccaccagcgagcgcgcgccgaaaggctttgcacctattgcgattggcctggcgttaaccctgatccacctgatcagcattccggtaaccaatacctcggttaacccggcacgcagcaccgcggcagccctgttccagggtgactgggcgatctctcagctgtggatgttctggttaatgccgattatcggtgccgtgattggtggtttgatctaccgcggtttagaggaaaaagcagcgtaatttcttcgatatgcagcggatcggcagcagtcgatccgcattttgccgcctcgccccatcttcgccttacgccatgataatgaaatgttatgatcccgccttcgtcacggcagtcgttcctgcatgatgactctctatggcaaatctgcataaaacataacattcttataaggaagtctggctatgctcgccacgttaacccgcctgttcccgctctgggccgtgctgttgtctgtcgccgcttattactctccaggtacgtttctcggcatcggaccctgggtcacttatctgctgatgctgattatgttcggcatgggtgtgaccctgaatatcgacgattttaaacgggtcctgacccgacctgcgccggtgattgccggaacctttctgcactatctggtgatgccgttagccgcctggggactggcaaaactgtttcatatgccgcccgatctggctgccggtatgattctggtcggctcagttgccagcggcaccgccagcaacgtcatgatctatctggcgaagggggatgtggcgctgtcggtgaccatctcgtcagtctctgcgctggtgggtgtgttcgccacgccgctgttaacccgcttttatgttgatacccacattcaggttgatgtggctggcatgctgctgagcatcgtgaagatcgtcgtgatccccatctccctgggactgatcatccatcacagcatgaacagcgtggttcgccgggtggaaccctggcttcctgcgttttcgatggtctgtattctgctgatcatcagtgcggtggtggcgggcagtcaggcctttattggatcggtgggtctgatggtgatcgcggcggtgatcctgcataacgcgattggcctgcttggcggctactggggcggtaagctgtttggcttcgatgagtcaacctgccgtaccctggcgctggaggtcggcatgcaaaattccggtctggcggcgacgctgggcaaactctacttctcaccgctggcggcattgccaggcgcgctgttctcggtgtggcacaacctgtcaggttcactgctggcgggttactggtcaggaaagccgattaagaagaagtaacagtggcggcgcattattacactgcgccgcatttcactgctgccgcgccggacgatcgccgctccggcgcggcaggttattcactccgctcagttttattcatagtcacgttcatcgtcgggctgttccagcaccgtgtaggccacactacaaaacagtgaattcaggcgcttcatgtcgcccagtaaaccgagatgcagcgaactggtctcaatactctgcacgttcttctggtgcaggcggtcaacatgcgcatgagagtagcggcggatcatcagacggaagcgatgtttagcgcggcgcagacgtttagcactggtgatatcgtgtgacagaaacaccgacagactcattctgaggttagcgatcagcagctcatgcagctcctgcagctcttttaatccctcggcagagaacgcgcggcccgctgccagcgatttgtcagcgacatcgccgctcatccgctcgatgatgtccccggcctgctccagatttagtgacatttcaatgatttcaccccagcgacgagagtcctcttcggggaggtcctcttttggcatccgcgccagatagagtttgatggcggtatagagcacatcgacatcatcatccagcctgcgcaccgtgcgtttcctcgcgggattcgccatgcaccactttattaaacgcctccagcatctgctccagcacgtcacccatgcgcaacgcttcgcgggcggcattcaccagcgccagcgccggcgtatccagcgcgctgcgatcgaggtgcttcggcttgaggtgcagcgcgttatccacgtcgtcggcaatcatacggcgacagaggcgcgccatcaggtcagcaaacggcaccatcgccacgcagcggatcaggttgtaaaacacatggaagaaaatcactaactcttcatcgttgaccggcagcttatccagccactccgccacaatatcgacaaacggcaggatgaacacacagccgattagcttgaacagcaggctgccgagcgccacgcgcttgcccgcggcattcgagccgctggcgttgatcatcgccagcaggccgctaccgagattggcaccaatcaccagacagagcgccaccttgaacgaaatcacgccggtagcggtgagcgtcgcggtgatcagcaccgcggccaggctggagtaactgatgatggcgaacaccgcacccagcagcgcatcgagcatcacgtcgccggtcaggctggagaaaagcacctggacaccggcggcctgggtaatcggccgagccgcttcgacaatcagctgcagcgccagcaatatcaggcccaggccgatactggcccggcctaactgacccgcacgggtctgcttgcggctgaggaagaacaccacgccaaagaagataaacagcggtgagagccaggagagatcaaacgtcaggatgcgcgccataatcgcggtgccgacatccgcaccaagaatcaccaccagcgcgggcgtcaggctgaccagattctgcgccacaaaagaggtcaccagcagcgtggtggcgttgctgctctgcaccagcgtggtcacgccaatgcccgccagaaacgccatcggttttttttctatgctgcgactcaggacgcggcgcagatcggcaccgtagacccgcatgatgccggttcgtacgatatgcgtgccccagaccagcagggccaccgcagagagtaaattaagcagggttaacacgtggtgtcgctcctcgaatgtcaggcttaaagcacagactgccagcctgacggaagagagcaatctgtgaaggggattgccgtgctatgcgtgattttttcctgtgttttaagccacctggcgcaaagtcgacatctccaattgtagaccaatcttcctgccagcgggatgcaaatccgccgccgatcggttaagcacatcaaccgaaagttccacatcatgcgcccggatacgatagcggatcacgttgcccagcaggctgtggctgaggatttccgcaggaatgccctggcccggcgcggtgaacagcatcgattccgggcgaatggccacctggctgtggaaaggccgaccggtcagtcgcgtcgcctgctcagcgctcagcaggttgtagttgccaataaatccggcggcgaagagatcgaccggctgggtatagagcgcttcggcatcgccgttctgcacgatttttccccggttcatcagcacgatacgatcggagagcgtcagcgcctcctcctgatcgtgggtgacgaacagggtagtgagattcagctcgcgctggatgcgccggatttgatcgcgcagatggcggcgaatacgcgcatccagcgccgacagcggttcatccagcagcagcagacgcggacgcgtcaccagcgaaacgagccagtgccacgcgctgacactgcccgcctgacaactggtgcggataacggcgtgcataatcattgagttcaaccagctccagcacctccagcacccgctggcgaatctgcgcttcgggcagtttctgcatcttcaggccaaatgcgacgttcttctctaccgtcatgttgggaaacagcgcatagctctggaacaccataccgatggcgcgcttctgcggggccagcggcacgatatctttgccctccagcctgatttcaccgctgtcgacgccggttaatcccgccagacaacgcagcagcgtcgatttaccgcagccgctggggccgagcagggtgacaaattccccttcagcggcgctgaaatcgatctgctcaaaaatgggcgtgggtccataggacttgttcagctctctgacctcaaggtaactcatattcagcctcgttcgggattcagggcgttggccagccaggtaaccagcagcaccacaaagaagtaggagatcaccagggcgctggtgaagtgaccgctgccgttgcgcatgttgaagaggtaaacctgcagggtttcatagcggttgccgaccagcaggttagcgaagacaaattcgccaatcaggaaggagaaagagagcagcacggcaatcagcatccctttgcgcaggttgggcagcacgacccacagcgccgcctgccaggtgctggcacccagcaactgcgcggcatcaatcagctctttgaggttgatcgcctgcatattgttcgccagcgcccggtagataaagggtaacgcgatagtgaaataacagccgattaagatccacggcgtgccggtcagcatcagcggtgacgaagagtagagttgcagtaatcccactgacgacaccaccggcggcacggcgaaaggcatcaggatcaggacgttcatcaccgcatccagtcgaggaaaatagtaagcgattacaaacatggcaggcagcaccagcaacagcgagaacagcagcgcacccaggcaaatcagcagcgaatggcccagcgccgtcagaaatcgcgggtcgctccagagctggatgaaccacttcaggctatagccctgtggcagaatggtgttactccagtcggacgacagtgcataaagcagtgtggccagtaaaggcagtgccagcagggtaaagagtaacccgaccattatccggtgatagaggtgctcagcacgtgacatggcggctcctttcatggctgtttcgcattgagatagctacggcgcaccagatattgctgcaccagggtgatcagcgccataatcgccaccagcagcatcgccagcgcgctaccggtgttgggatccagcgagatatcgccggagaccagcgcggcaatacgcaccggcaccacgttgaaattacccgtggtcagggcataaatcgtggcgtaagcgcccagcgcattcgccagcaggatcacaaaggtcccgagcagcgccggaaacagaatcggcaggccgatatgccaccagtagtgccagcggctggcacccagcagcgcagcggactcctgccactcttttttcagcccgtcgaacgccgggtagagcagcagcacgcccagcgggatctggaaccaggtgtagaccagcaccatgccgttgcgcgagaagagtctgaagctctcaaccagaccataatggcgcaacagcaatgtcaggcagccgttcagccccagcagaatcacaaaggcaaacgccagcgggacacccgcaaagttgctggtcatattggtaaaagcgatgagaaagcgctgcagtcgcccgccgccaagctgatgcagtgaatagccggtgaccagtgcaatcagtaagccgtagacgcttgaccagagtgagatatccagcgaaaaacgaaacgcctgctggtagaagggcgaggtgagaatgtcctgatagttatcccagccccactggctgttcatctcactccagaagctgttaatggcgatccacaacagcggtgccagctgaaaggcgacccagaacagggtgaacggtaacagcagcagcagcgcgactccttttcctctcatctcttcggctccgccagcagcccgcgacaaaccggcttgtcatgcgccacctcaagcagttcacacagcgtgccgcacagatcggtctgttgcggtgccaggtcaggctgcagcgagaaagcccggccaaagacaaacagcggcaccgtggtctcttccggcagaataccgccgtgggagcgatcgtcattcatgccgtgatcggcggtcaccatcacctgatagccctcagccagccacaagggcatccactgcgacagcaggccgtcggcgatgcgtgcccggttgcggtactgtggtgaggagaggcccgatttatgaccggcatcgtcgatattcatcgggtggattaacagaaaatcgggatcgtgacgcagccgcaggctctctgcatcttcaaacagatgcgagtcgggatagctatcatcagaataaaaatggccatactgaatgggcaggtccggcgcgtcagtgtgacgatcgcgcgccggaacgaacggcgttcggttataaagctcactcacccagtggtaggccgccgccgcagtcgtcagtcccgccgatcgcgcaaagtgaaagatgctacgctcgcggcttaaccgactgacgccattatgaataatgccgcttctgaccggcggaacaccggtcagaatgcactcataaagcgggcgtgacagcgagggtaattcacaggtcatacggtaataaaacccgttgccctgcgaacattcggcatgcaggtaacccattgcatgttgtgcgacctgattgctcaggccgtccagcactaccagaatggtcttcattccgttctccctgccgcgaattactgctgcatgttgatgatgacgttttcctgccacaggcgcggcagcattttcgacgatttatcccaggcagcctgatccttcaccggacgggcatttttatattcagattgcggcagcaggcgagcctgaaacgtccgctggcagcgtcagatgttcagcacggataggacgggcatagcctttcgccagattgatctgtccctggtctgagaagatatattcgcgcgtcagttttgcggcgttagggtgtttcgcatatttgttgatgacggtggtgtagccggaggtcacggagccatcagacgggataaccacttcgtagcggtttttgtcgatctggtcccggtagttaagggcgttaaagtcccacaccaccgccatctgcacttcgcctttttcgatattggcaatcaccggatcggtaacgccaagacgaccctgtttagccagatcggcaaagaaagccagcgccggtttcaggttcttctcatcgccacctaaggcgtagtttgccgccagtacgccgttagccgcctgagctgccacgccgacgtcaccgatagtaaccacatacttaccttttttcagatcggcccagctatgggggatatctttaacctgctgcttgtcgatcagaaaggcgatggtgccggtataggccagcgcccagtggccatctttatctttagcccaggccggaatctgatcccagtgagtgggtttatagggctgggtcacacctttagcgacagcgatcgggccaaaggcggcacccacgtcaccgatgtcagcgctggcgttctctttttctgcatcgaatttcgccagctcctgcgccgatgacatatcggtatcgctgtgcttaaggccatatttgctgctgatgtcgttccaggtatctttccagttagcccagctatccggcatcccgacgctgttgacctggccttcactgcgtgccgctttttccagtgcggcaaggtcgttatcggcggcctgcgcaacgggcagggtgagcactacagcactggctactacagaggcgataaacgctttcatctcagttgctccgggtgtaagttgatgggcctggctggtctagtccagcaagaaccgagccaatgtagcccctgtatatgaacgatttatgacagggcggcgctgtgcgggggatgggtgatgaaagatgtgacccgttcgcctgtcacaggcgcatttacctgaacagtaagagtgcggagtcgcaccaaaatgaggctactgttgtggagtcgatagcactcaaaacggcggatgcgatcgccagcgtcctgctgacgcgcattcaggccggagagttcagcgccgggcgactgccggcggagcgtgccttaagcgaagcgttcagcacgacccggattaccctgcgggaagcactgggcaagctggaagcccagggaatgatctaccgggaactgcgtcgcggctggtttatcgcaccgccgcgactgatctataacccgctgcatcacagccactttcatgccatggcaatggagcagggacggcaggcggccaccgaggtcatcgccgccgaacaggtcgcggcgcacgacagcgtggcgacggcgctgcggctggcctccggtttcggcggtttactgcatccgccgcctgcggcgcatcgacgggcgcgcggtgctctatgttgaacactacctcaatccgcgtttttttcctggtctgcttgatgaagatttgacccgctcactgaccgatctctatgaccagcgctacggcattcgttacggcggcgcgcgcttcaccatcctgcccggcccgctgccggaggtcgccgcacccatgctgaatgtggcaccgggcagccccggtttgttgatcacccgcatcaatcgcaaccagcaaaaagaggtgattgattgcgactgtgaatactggcgttacgatgcgctctgtgttgatgtggaggcctgaggagttattgtgatttgcgtcacactcgcgcatgataccgcgcgctaacaactccttttttaaggcgcaacatgagtgacaaaaatcctttggcccgccaccttgcaacggtactgcaatgggtgctgaatctgggtctgctgagtctggcgatcatcctgatcgtctttttaggcaaagaaactatccatctggcaaacgtgctgtttaacaccagcgagcagtcatcctcctatctgttgattgaggggattgtcatttatttcctctacttcgaatttattgcgttgattgttaagtactttcagtcgggatatcactttccgctgcgctattttgtctatatcggtatcacggcaattatccgcctgattatcgtcgaccataaaaatcccttcgatacgctctgttactctgcggcgattctgattctggtaatcactctgtggctggcaaacagcaaccgcctgaaacgcgagtaatctccctgccgtctgtcatgacggcaggtgttcgcatcgcgtctctgcgctaaactagcgtcctgaaaattattgggagtggtgctatgtcgcaagacgcgctcagcttattacgtgcgctcaactggctttctccgtcgcaggcaacccttgcgccgccattgctcgactggctgatggaggaggattcaatgacgcgccgttttgaacaacattgccagcgggtcacggttcagccgctgcgtgaaggctttatcgacgccagcgaattgggtgatgaaaagggcttgttgccagacgatcaacgcttctggctgcgcgaagtgttgctgttcggcgacgatcagccctggctggctggccgtacgctggtgccggaaagcaccctcaacgggccagaagcgatgctgcagcagctgggcacccggccgctgggtcgctatctcttctcctcttcaacgctgacccgcgattttattgagccggggcaggtggagggattgtggggacggcgctcacgcctgcgtctctcgggcaaaccgctgctgctgactgaactgtttttaccggcatcgccgctctatcgcgatctggtctgaggatcctgtggtgcaaaatagcttaagtataaataaatggcgggcctacacgcgcctgatgcgtatcgataagcctatcggtacgctgctgctgatgtggccaacgctctgggcattatggctggctgacatggcgatcccgccgctgccggtgctggcggtgtttgttgccggggtcatcgtgatgcgtgcagccggttgtgtgatcaatgactatgccgatcgcaaagtagacggtcatgtcgaacgcacgaaacatcggccactggccagcggcgcggtgagtgcaaaagaggctaagctgctgtttcgtgatactggctctggcggcttttgcgctggtgctgaccatgaacatgatgacgattatgctctccgtggtagggctggcgctggcctgggtctatccctttatgaagcgctatacccacctgccgcaggtagtgctgggtgccgcctttggctgggccattcccatggcatggtccgcagttagtgagtccttacctctggtctgctggctggtattcatcgccaacatctgctggacggtcgcctatgacactcagtatgcgatggtggatcgggatgatgacctgaaaattggcgtgaagtcgaccgcgattctctttggccgtttcgacaagctaattattggtctgctgcaactggcgacgctgctgctgatggcgctggttggcctcatgctacatctgaacagcgccttctactggacgctattactggccgccgcgctgtttgtttatcagcagaagttgatcgccggacgcgagcggcaaccctgtttccaggcttttctcaataataactatgtcgggatggtgctgttcctcggtgtactgatgaacaccccgccgttcagccagctgttctgatagagagtttccagacataaaaaggcgatccgggaggtcgcgaaacctgatgaggatgaatctggcagcaatggatgagctcaacgcgcagggaacatgggcagaagaggaaagcgtcccgcggcagggacggcgcgggccgagcagtcagggatgacgcttttgcgtctttccgatctgaccatgttccctgagcaggcaccgtcttacagcgaatcggaccagacctggcctataaaaaaggcgacctcatgaggtcgcctttttactatgcgcgctggggtcagtcgtgcgccacagcggtttcaatcgtcatacggacatcgctggtgaccaggtctgccagcatatgccaggtcgccagagtctgcgcaacatcggcatcaccgctgtcgctgatatacccttcatcgcgcagggtcagaaccagtgaggtaaagaccgctttgtcgaagaattccggagcattgataccgtgcagcaccgacagacgctgtgccagcgtccggctctctttttccagcgtgccgcggttaatcgtcggcttggcgctgagaatggagaacgtaatagcatagcgctgcagtgtttcacgcacaccggcggccagcagttgcagcgtgcgatagcgcgctgaggaaaagcgcaattcgccagcttcgagcgtaatcaggccctgacgcgccagctcctgactcagttcggtcagcagttgcggcagttcatcggtctgccagcgcaggaacagctcactcttcagcatcgggtagatcaggctcacctgacgcagcagttctgcttcgctcagcgtctgatgttgctgaacaatggcggcaatcagcgacggcatcaccagcatatgatgaatattgttgcgatagtaggtcatcagcaccgcctgctcacgcggcagaatgatgatgtcgccaatgctatccttttcactctcaaacttattcatacccatggcgtgatccagcagcgcttccgctgaaagatcgggtacggtcgcatttggcgagtaaggcacgttgcgcagcaattgggtatagcactccagttgttcaatcagctgttcacgggttagtgagcgctgacgtgacgccagcagggcggtgacacagaggttcatggcgttagccgcgcccgcttcattgatacgcaccatcaggctggcagcaatatcgttgacggttggggttaaccaactgggacgctgcggctcaatcggatcgatggcatcgcgccattccggcacccgcttattgagatagttgaccagcggcaggggttcgccaaagttcacgtaaccctgaccgagattgcgcagcttgcgtaagccgcgcaccatctgcatgaagccctctttctctttcgccgcgccgcgcagttctttagcgtaagtgcccacttccatcacgtgctcatagccgatatagatcggcaccagcgtgatggggcgatttccgcctcgcagcatcgcctgcagcgtcatggctaaggtgccggttttagggtccagcaggcgaccggtttcgtgaacggcctccttcgacaaagtactcaaccgaatagccgcgggtgaatagctcgccgagatattcgcggaataccgtggcgtagagcttgttacctttaaaggtacgacgaataaagaaagcgcccaggcgacggaaaatcgggccggctggccagaagttgagattgataccggctgcgatgtgcggcggcaccagtccctgatgatagagcacataggagagcagcagataatccatgtggctgcgatggcacggcacatagacaatctcgtggccatcctgcgccagctggcggactttttcgccgccattgacgttgatgccctgatagagccgactccagagccagcccatcacgcggtcagttacgcggatggcttcataggagaagtttgccgcaatctcctccatcatttcgacggcgttctgctgcgctttctcatgggagatttttttgctgcgagcttcatcttctactgctttttcaatcgctttggattgcagcagacgattaaacagatcctgacgcgccggcaagcgcgggccaatcgccgccagccgctggcgggcaaaatgaatgcgcgccacgcgagccagcttctgggcgatcgactgatccgtaccgtgttcagttgccatgcggcgcagcgacactgtcggcgagaagcggacaaaactgtcgcgcccgtgccagatcaccgcaaaaaacttctgcaccccgttcagcacccgcaggtgtggcgttgcttcgccctggacttcacgtcctggtgcgcggccaaacatcaccgtgaccggcagcatctgaatatccagcttagggttattgcgatgcaggtccaggtaatcgtgaaagattttcacggattcaacgctgggcacaaaataggggaagacgcgagggccattgtggataaagacgtggcgcggcagcagagaaccatcaatctccagcggagtgagcgggtcgggcagatgatgccgcagacactgtgcgcgtaaagtcagtaagtcggccttcgaatcgtaaggcaaaacatacataataggtcgggtcggatccagaccatgttcagacacgggatcggccggaatggccttactttttaccaaaaacgacagtggtaaattaagcagtttgtaatagagtttacgccaacctgacatagacaacatgaagcctcttgttagcaaagcgccgcaagcataccagaaagcgcagcgaagatctgtggtggtgccaattgcacgcagcccagacattgacgtcaatccgatgaaagggttcccacatcatggcaaataatgccaccggacttatcagaatagtaaaagctgcaggttactcatggcagggactgcgtgccgcctggcaacatgaagcggcgtttcggcaggaagcgctggctgcgctggccgctattgttatcgcgtgctggctggatgtcgatgtggtctcccgcatcctcatgattggggcggtggtgctggtggtcattgttgaaatcctcaatagcgccattgaagcagtggtcgaccgcatcggtcaggagcatcatccgctggcgggccgggcaaaagacatgggctcggcggcggtgttgatcagcatcttactggcactcttcgtctggatcgcgctgctctggacacatttgcgataagccttccataacgcgtctgagggcgcgttttccctgacaatcggtttccatttcaccaatacctgtatatactcacagcgactgtataaacaaccagggggcgggatgaaagcattaaccagcaggcagcagcaggtctatgacctgattcgcgaccatatttcttcaacgggcatgccgcctacgcgtgccgagatcgccgcgcagctgggcttccgttcgccgaacgcggcagaagagcatctgaaagcgctggcgcgcaaaggcgtcattgagatcgtttccggtgcatcgcgcggcattcgactgttaatggaagaagaagcctcagaagggctaccgctgattggccgggttgctgccggtgagccgatcatggcgcaggaacatatcgaaacccactacaaggtcgatccgggcctgtttaagccgtctgctgacttcctgctgcgcgtcagcggaatgtcgatgaaagatatcgggattatggatggcgacctgctcgcggtgcataaaacccaggatgtgcgtaacggccaggttgtggttgcccgcattgatgatgaagtcaccgttaagcgctggaaaaagcagggtgctatcgtgcatctgctgccggaaaacagcgattttgacccgattgttgtcgatacccgtgcgcagtcactgaccatagaaggtctggctgttggcgtggtgcgcaacggcgagtggctctgattcttctgccagcgtgcattcgccttctctgatgctattctgtctgccctaattttgtcgctgcctcttttgcgcagcgacactgagcacggaacggcgaatgcgctttattacggcaaccgataaaaatctctggcggcttgcgctgccgatgatcctttcaaatatcaccgttcccttactgggagtggtcgatactgcagtaattggtcatctcgacagccctgtctatcttggcggggttgcggtcgggactacagtgaccagcttcctctttatgctgctgcttttccttcgaatgagtaccactggccttacggcgcaggcatttggcgcgggcgataaaatggcgctggcacgcgcgctgactcagccgctgatcattgcgctgctggcgggcgtactgttcatcgctttgcgttatccgattattcagctgtcgacccatctcgttggcggcaatcccgatgtactcgagcaggcggcactgtttattcagattcgctggctcagtgcgcctgccacgctggcaaacctggtcattctgggctggctgctgggcgtgcagtatgctcgcgcgccggtgatcctgctggtggtgggcaacctggttaacatcgtgctcgatctctggctggtgatggggctgcactggggtgtcgcgggggcggccaccgccacggcgctggcggaatacattacgctgggtgtcggcagcatcatggtctggcgggtgttaaaactgcgcggaattacgcttagcctgctgaagcagagctggcgcggtgacagcggccggctgctgcgactgaaccgggacatcatgctgcgctctctgatgctgcagctctgtttcgcctcgctgaccgtactgggtgcccggctgggtccggatgtggtggcggttaacgcagtattactgatgttcatcacttttacggcttacgcgctggatggctttgcctatgcggttgaagcttttgcgggtgaggcgcatggtgcaaaagatggcagcaaacttctgcgcgtctggcactctgcctgtcggcaggcggtggtggtggcgctgttcttctcgctgatctatgccatttttggcccgcaaatcgttaccctgctgacctctcttcagtcactccagcagacagcggaccgctatctggtctggcagatgattatgccgctgatcggtgtctggtgttatctgctggatggcatgttcatcggggcgacgcgcgggcgcgagatgcgtaacagcatggtagttgccgcagccggctattttctgacgctgcttagcgtaccggtgctgggtaaccatggtctttggctggcagtcacggttttcctggcgctgcgaggcctgtcgctgtggctcatctggcgtaagcactggcgtcagaacagctggtttgatgcatgagtcagccgtggctgcacgcaagccgatacggattattctgtattattccacggttaagaaattggctactacaattaactctatgcagcgcagttaaccagcgctttgtatcgttattttgttaagtagcaagataatcatcaaaacccgaggattggaggtctgccatgaataaagacgaagcaagcggcaactggaagcagttcaaaggcaaaatgaaagagaaatggggcaagctgaccgacgatgatatgcaggttatcgaaggtaaacgcgatcagctggtcggtaaaatccaggagcgttacggctctaccaaagatgaagccgagcgcgaagtaagcgactgggaaggtcagaacaaagatcaccgctggtaatcagacaatagcttgataatcagctgaatgtgttccggtgggccctcaccggaaaccgcacaaggatgtgccgattacccgcgtttcccccgctttttaccctcatcctgatggtcatgctcgcagctttcatggtgcgtacaggcttcaaccgcagcacaattttcacataaaccatgcgcttcaatcacgctatggcgtaatgcaaactgcgcttcacctgccagactagcaataatcttctctacgccctgcgcctgcttctctgtaacggcggcacagcggtcacagaccagcatcaccgatgtatgtgctggtgcctcaaaatggtgacacatgacgtagctgttgttggattccacccgatgaatgaaaccctgctccagcaggaaatcgagcgcccggtaaaccgtgggaggcttggcctgtggctcgctgacccggagttgatccagcagatcgtaggcgctgatcgagccaggctgctcggccatcaggcgcaacacttcagcacgctgcgaagtcagacgcacaccgcgctgcaggcacatcttttcggcctgaatcaaaatttgctgcgacgtcatgtttgtcatgaaaattctccgctggataagtgatgttattttatcacacatagtttcgcggcgctgaggttggttttcgtctgaaaaaacagcatcatttgcctgataaagcagcatattcagaatttaagccgtcttctatctcaaatctgacgacaaatcagatccattctgaatccacctgaagcggaatttgttggcattttgctttgcatctcactgagttaagaagtaatgttcagaaagacttaagaaaagcctggcattatttgaaatatcccaatgcagtttgaacaattacaacggttttttgattggaaaacgtccaatcctttgaattaagacactgtttcctttgaattcacagcaataacgcgttagccagggttcacaatagggctaacaaactattcagtcattgaatgtttcaatggcaatttctcaggtgatggcaggcaaatggtgaaaaaatccgctcaacgttcagcgctaatctacacagctgtaacgaccgcgcttttcctttcttcttccgccatggcggcagggacctggtatgatgcacgtaatgacgccatgggcggcaccggcgtagcatcttctctttatggctccgcagtgctggcgaaacccggcattaatgacgcgcgccaaacccgacgatagcgtcagcattatttttccctcagcgggcattcaggtgactgacaaagataagctgatagataaagtggatgatattaccgacaccgtggaccgttaccgcgacgtgctcagtaatttaaccttcgctgattatctgcgtggctatcctgaagtgcgcgccgcctcaggcgatgtcgccaaccagctaaatgatttacgcggcaacaaagcggacggtaacgccggggttgccctggccgtcactatccctgacgagacgctgcctttcgcctttatcaccaaagcctatggctcagcgcacgtgcgtgccaatgtggtccagagcgatatcgactatctgcgcggtgtggctaacggcacagtgcttcctcgtcctggcgatcaaaataacctgcgctccagcgcgaatggcttagcggcgctggtcaccgattatggtgttgcggtggcgcatgagttcaccatcgctggtcagccagtatcggtaggcgttacaccgaaagtgcagaaaacctggctctataactacaccgccagtatttacaactacgacaaaagtgacatcaataacagccagtatcgcagcaccgacaccggctttaacgttgatgccggtctggcgaccacctttgctgaaaactggacgctgggtgtaaccggacagaacctggtttcacgcgatctgcagaccaaagaggtcaatggtttccgcgacacctaccagatccgcccgctggtcaccaccggtctggcctgggataaaggtccgtttaccgtgacgggcgatgtggatctgactgaaaccaaacgcttcaaaactcaggataacagccagtatgcggcagtgggcgcggaataccgcgtacttgactggctgcagctgcgtgcaggttatcgtgcggacatgcgttctaacgacgaaaatgtcgctacggccggttttggtctgtcaccgtttaacaaagccgtacatctggatctggcgggctctgtaggtgctaacaacacctggggcgcgatgatgcagctgggctttaacttctaagcgcgttaatcagactgttcgggggcgggcgatgcactatcgcccgcccttgtgttatccttgcacagaattccatcaccccttaattaccggattgtctgcgcttcatgcctaatttctcttcgcaacgtttctctatcgcccctatgctcgactggaccgatcgtcactgtcgctattttcatcgccagctgaccggtgacacgctgctctacaccgaaatggtgaccacgggcgcaatcattcatggcaaaggggattacctggcttacagtgaggctgagcatccggtcgcgttgcagcttggcggtagcgatccggcggcactggcgcagtgcgcgaagctggcagagcagcgcggctacgatgaagtgaatcttaatgtcggctgtccctctgatcgggtgcagaatggccgtttcggcgcctgcctgatggccgaggcgaatctggtcgcagatgccgttaaagcgatgcgcgacgtagtttcaattccggtcacggtgaaaacccgcattggtatcgatgagctggacagctatgaattcctgaccgattttatcggcacggtggcgggacgcggtgagtgtgagacatttatcattcatgcgcgtaaagcctggctctccggcctcagcccgaaagagaaaccgcgagattccaccgctggattatccccgcgtctatcagctgaaacgcgattttccgcaactgaccattgccctcaatggcggcgtgaaaaccctggaagaggtactgacccatctgcaacaccttgacggcgtgatgatgggacgtgaagcctaccaaaaccccggcattctggcgcaggtcgatcagacattgtttggtcgtcagcatccggcggcgaacccggttgaagtggtgcgcgccatgtacccctatattgaagcggaactggcaaaggggacgtatctgggacatgtcacgcgccatatgctgggtctgttccagggaattccgggcgcccgccagtggcgacgccacctgagtgaaaatgcccacaaacccggtgccgatgtccgtgtgctggaggcggcgcttgcgctggtcgccgataaaatcccgcaggaagcctgacgcctcatctgaacccgaaaaaaccagctctgtttgctggtttttttacaccactatgtggtttttctcaccaggttgcgctcttctgtttatctcttatcagaatgaaatcaatgagttaactgttggcacgttttttgtaatagctataacaatcaatctcaaaaaggagcgctgacgtggaaattttattcgtattggggtttttcctgatgctgttgctgaccggcgtttcgctgttaggcgtgctggcggcactggtggtcgcaaccatcgtgatgtttgtcggtggactgtttgcaattgttattaaagtgttgccgtggctggtgctggcggtgattgcggtctggctgcatcgtgccttttttggcgacagcgatgagcgagcacgtcgcaagctgcggcgtaagatcaacaggttagaccgcaaaggctggcgctaaatgcggtgaagatcacagtgtgagagattggtcggggctgatctgcaattaaacatattttttacttatgttttctggcaggatgcctgtcgtcaaatcgatgtgccatcgactcgacacgaattcatcgccgctgtccctacaccagcgcgaacaaaaaataaaaaaagagaagggcttcccgcgggaggccctttttgttgctcactactatggaattaagagacaggatccctgcgtggcgcggctctccagcatctggtgcgctttgctggcctctttcagcgcaaacttctgctgctccggcacatcaactttaattgcgccactcgccagcagcgagaaaagctcggcactggcggtttccagctcctggcggttggtgatatagccaaacagtgaagggcgggtcacaaacagcgagcctttcttattcagaatgccgagatcaatccctgtcaccggacccgaagcattgccaaaactgaccatcagcccatgacggcgcaatgagtccagcgatgcttcccaggtatctttgcccacggagtcataaactacgcccacttttttcccgtcggtcagttcgctgacgcgttgcgcaatattctcttcgcggtagttaaccgtcgcccaggcgccggcctttttcgccatcgctgccttttctgctgacccgactgtgccaatcaaatgggcacccagcgcttttgcccactgacaggcaattaacccgacgccgcccgctgcggcatgaaacaggaaggtctcaccggcgctgattttataggtctggcgcagcagatattgtgtggtcagccctttcaggtagctggctgcgccctgctcaaagctgatcgcctccgggagatgcatcaggcgatcttccgccacgttgtgcacttcgctataggcccccatcgacgccagacagtagaccacgcgatcgccgggcttaaataatgtcacgccacgtccaacccgcgacaccacgcctgcggcttctgtacccaggccagagggaaaagcggcgaccggataaagcccgctgcgaacataggtatcgatgtaattaatcccgatagcgcgatgttctacctgcacttcatgttcggccgggtcagcaggttcaaaatctgtccactctaaaacgtccgggccgccatgtgcgctgaactgaatacgctttgccattctgactcctgtgattgtttcatcatgagggtgaggcacgcaccccaactaaggtatacttgcgcgtccccacagaagatcggtaatgcattcactatggcaggaaataaacccaccaacaaatcgaacgaaacgcaggatcgccagctcgcaggcgtgaaaatgcccccgcattcgctggaagcggagcagtcggtgctcggtgggttaatgctggataacgagcgctgggacaatgtctctgagcgcgtcgtcgcgaatgattttttcaaccgctcgcatcggctgattttttcagagatgcagcggctgctggaaaacagcaaacctattgacctgattacgctctccgaatcgctggaaacccgtggcgagctggagatggcgggcggcttcgcctatctggcggaactggcgaaaaacaccccgagcgcggcgaacatcggcgcctatgctgacatcgtgcgcgaacgtgcggtggtgcgcgagatgatcgccgtcgctaaccagattgccgatgccggttatgatccgcaggggcgtaacagcgaagagctgctcgacttcgcggagtcgaacgtctttaaaattgcggaagcgcgcgcggataaggatgctggcccgaaaaacatcgagcagattctggaatcgaccgtttcccgtatcgaatcgctctatcagacaccgcacgatggcgtcaccggcgtcgataccggctatcaggatctgaataaaaagaccgcgggcctgcagggttctgatctgattattgtcgcagcacgtccttcgatgggtaaaaccacctttgcgatgaacctgtgcgaaaacgccgccatgctgcaggaaaaaccagtgctgatcttcagtctggagatgcccagcgagcagatcatgatgcgtatgctggcgtcactctcccgcgtcgatcagacccgcatccgtaccgggcagctggatgatgaggactgggcgcgtatttccggcaccatgggcatcctgctggagaagaagaacatgtacattgatgactcttccggcctgacgcccaccgaagtgcgttcgcgcgcccgacgcatctaccgtgaaaacggtggattaagcatgatcatgatcgactatctgcaactgatgcgcgtgccgtcgctgtcggacaaccgtacgctggaaattgctgagatctcccgctcgctgaaagcgctggccaaagagctgaacgtgccggttgtggcgctgtcgcagcttaaccgctcgctggagcagcgagccgataaacgtccggtcaactcggatctgcgtgaatcgggctcgatcgagcaggatgcggatttgatcatgtttatctatcgcgatgaggtttaccacgaaaacagcgatcttaaagggatcgcggagatcattctgggtaaacagcgtaacggcccgatcggtacggtacgcctgacctttaacggtcagtggtcacgcttcgacaactacgctggcccgcaatacgacgacgaataatccccggtttgtgctgtcatgcacgatctgtgcatgacagcccccatcatcacaaaatagtgttggacaacctctcgggttatcgggttatctgtaacaaagtgacgcctggcaccgatgtggaaacggaatgactcacgtagacgattacgaccttaaaatcctgactttattacaatccaacggccgtctgaccaatcaggaaactcagcgatctggtcggcctttccgcctcacaatgttcccgccgtcgtatcaatctggaacaggctaatctgatcctgggttatcatgcccggctgtcgcccgacgccatcgggcttggcatggtgggattgattgaggtgcgcttaattaaccacaccgctgaatatgtcgagagctttcaccggatggtggagcaggagcaggcgatcgtggatgcctataaaactaccggcgatgcggactatctgcttaaagtggcggtggccgatctcaattcccttagtgcgttaatcagccagttagtcgcgggccaccagagcgtttcccatgtgaaaacctcggtagtgctgggacgcatgaaagagaacgggctgatgatgctgcctgagcacaagacgcgctaaaaaggtgcgcgctgtacgcttttggtgcacacttgcggcaattaatgcgaagagcgtgcatcgaaacggactttaacgcataggttgacggtatcagccggaatttatgcacaaagttctgttttaaagcgccttagatatcaatgggatatcgctggcacccggtttacagcagttcagtgctgtggcgatggtgcgttttttgcatcgaaaccgcatcatttgccctgagaaaaccccatggataacatcgcagaaccctcccgcgtcccgcattcgcgcattgaagatgcgctggcgatggtgcttggcaccctgatggtctcgttcggcgtcattatgctgaaacaggcgggggcgctgaccggcagcaccgcaggcatcgcctttctgatcagctacctgtcgccgctttcgttcggcagcgcgttcttcctgatcaacatccctttttactggctggcggtaaaacgcatgggctgggaatttacgctgaaaaccttctgcgccgtcggtctggtgtcgctgtttacccagctgcacccgctgttcgtccacttttctgaccttaaccccttctatgcgacactgttcggtaacgtcatcatgggaatcgggtttatagtgttatttcgtcataaggcgagcctgggcggcatcaatattctggcgctgtggctacaggatcactttgggatccgcgcggggaaactgcaaatggccgtcgatacctgcgtcgtgctggcgtcactgtttgtggtgagtggccccatcctgctcgcgtcgattgcgggtgcggtgatcctgaatctgattattgcaatgaaccaccgtccgggacgctatcgggtttaatccgcatcttccctctggaccaatcatggagacctacaccgtgtttcaaaacgttgatgcctatgctggcgatccgattctgtcgttgatggaagccttcaaacaagacccacgcgaacacaaagttaacctgagtatcggcctctattacgacgaaaagggcatcatcccgcagctgaaggctgtagccgctgccgaagagcagatctatgctgagccgcatcaggcatcgctctatctgccaatggaaggactgaacagctaccgtagtgcgattgcaccgctgctgtttggtgccgatcatccggtgttaaacgcgggccgtatcgcctctattcagacgctgggcggttctggcgcgctgaaagtgggcgcggatttccttaagcgctacttcccgcagtctgcggtctgggtcagcgatccgacctgggagaaccacgtcgcgatttttaatggtgcaggttttgaggtaaatacctatccctggtatgacgcagagacccacggcgtgcggtttgatgcctttatcagcaccctgaaaaccctgccagcgcagagcgtcgtgctgctgcatccctgctgtcataacccgaccggcgctgacctgactgatgcgcagtgggatcagaccgttgaggtgctgaaagcacagcagctgattccattcctggatatcgcctatcagggctttggggccggcatgcagcaggatgcctatgcgttgcgcgcggtcgcggcggcgggcctgccagccctggtgagcaactccttctccaaaattttctcgctctatggcgagcgcgtgggcggtctctctatcgtctgtgacagcgccgaagagtcagcgcgtgtgctgggccagttaaaagccacggttcgccgcaactactccagcccgccgaatttcggtgcgcaggttgtcgcgcgcgtactcaacgatgacgagttgaaagccagctggctggctgaagtggaagcgatgcgcttacgcattctggacatgcgtcagtcgctggtggacgtgctgagcactgcactgccaggtaaaaacttcgactacctgctgaagcagcgtggcatgttcagctacaccggcctgagtgcgcagcaggtcgatcgtctgcgcaacgaatttggcatctatctggtgggcagcggccgcatgtgtgtggccggtctgaacagcaaaaatgtgcatcaggtggctgaagcgtttgccgccgtgatgtaacggccgccaggctgtaaaaaaaaccgtcagggtgctctctggcggtttttttatgggtcagggtttacctttcggcgacatgctgcacacttaaacggggtaaccgtttcaggaataagctatgtggcatcaacaaactattacgctgagcgcgaagccgcgcgggtttcatctggtcaccgatgagatcgtgaactcgctctccggactgcgtgatatcaaaaccggtctgctgcatctgctgttgcagcacacttcggcgtcgttaaccttaaatgagaattgcgacccgacggtgcgcagcgacatggagcagcatttcatgcggcacgtgccggagaatgcgccttatcagcacgattacgaagggcgtgatgatatgccggcgcacatcaaatcgtcgatcttaggggtttcgttgttattaccggttcagcggggacgtctggtgctgggcacctggcagggtatctggctgggcgagcatcgcattgagggcggtgccaggcggattgtcgccactttacaaggggaatcgtaatgaataactcagacttactgacctattgcatgagcaagccgggcgcggagcagagcgtccacagtgactggaaagccacgcagattaaaagcaacggcgtgctgtttgcgatggtacatgaggcgaaagggcggccagcggtctcgctgaaatcgacgcctgcgctggccgaattactgcgcgaagagcatagcgatattattcccagcgagcatctgaacaagtcacactggagcacgctgtttcctggacggttcgctgaaagattcgcagatctactatctggtcgatgcctcattccagcaggttgcaacggcccgctaaacggcaataaaaaaccctcttacctgagtaagagggtttcagagaccgcgggttacgcggcaggctgctcgcgcagggtattaatgtcgataacgaagcggtatttcacatcgcttttcagcatgcgctcataggcttcattgatctggtccatcgcgatcagttcaatgtctgacgtaatgccgtgctcaccacagaaatcgagcatctcctgggtctctgcgatgccgccaatcagtgaaccggcgatgctgcgacgcttgaagatcaggttaaatacctgcggtgccgggtgatcgtgctccggtgcacccaccagcgtcatgttgccatccagcttcagcagggtgatgaaggggttgagatcgtgctgagccgccacggtattcagaatgaagtcgaagctgttggcgtgctgcgccatctgctccgcatctttagagatcacgacttcatcggcacccagacgtttgccatcttcaattttggaaggcgaggtggtgaacagcaccacatgtgcgcccatggcatgggcaattttcacgcccatatggcccaggccgcctaagcctacgatacccactttcttgcccgggccgacattccagtggcgcagcggcgagtaagtggtgataccggcacacagcagcggtgccacgcccgccagctccaggttctcgggaatgcgcagcacaaagctctcatcaaccaccatcgacgttgagtaaccgccgtaggtaatggcgccggtttcacgatcttcaccgttataggtgccaacaaagccgttttcacaatactgctccagaccctgctgacagctcggacagctgcggcacgaatcgaccatgcagcctacgccgaccagatcgccgactttgtatttctgcgtctgcgggccaacggccgtgacgcgaccgacaatttcatggcccggaaccacgggaaaaatggtgtttttccactcattacgggcctgatgcaggtctgagtggcaaacgccacagaacagcacctcaagctgaacgtcatgggcgcgcagctcacgcggcttaaaatcgaacggtgccagtttggattttgcatcctgagcagcatacgcatgcgtaatattcatggtgtctccagtttcgatgtgtcgtgagtgttattcgatgaagtgcagcagcgttgatgtgctgcgaaaacagggcgacgccaggggcgtgccaaagaggaaccgcttaaggatagtcagcgtggggaaaagcgtatatgcctatacatgtctgaatcttgcctgattctgcaattttctggctgaatcgacaggggagagtaaaaggcccgcacgcggcgggcctgacagaattacttctgtaacagtggcttcaggaagcgcgcggtatgtgatttctcacactccgccacggtttctggcgttccagccaccagaatttcaccgccgccgctgccgccttccggacccaggtcgacaatccagtctgcagttttgaccacatccaggttgtgctcaatcaccacgatggtgttgccctgatcgcgcagcttatgcagcacttccagcagctgctggatatcggcaaagtgcaggccggtagtcggttcatccagaatgtagagcgtctgaccggtgccacgctttgacagctcacgcgccagcttcacgcgctgggcttcaccgccggaaagggtggtggcggactgaccgaggcggatgtaggtgagacccacatcgatcagcgtctgcagcttacgcgccagcgccggcaccgcatcgaagaactcacgtgcctcttcgatggtcatttccagcacttcgtgaatgctcttgcctttgtacttcacttccagcgtttcacggttatagcgtttgcctttgcactgatcgcacggcacataaatgtccggcaggaagtgcatttcgactttcagcacgccatcgccctgacaggcttcacagcgtccgccacgcacgttaaagctgaagcggcccggattgtagccgcgtgaacgtgcttccggcacgcccgcaaacagttcacgcaccggggtgaagatgccggtgtaggtggccgggttggagcgcggtgtacgaccaatcggactctggtcgatgtcgattactttgtcgaagtgctccagtcccgccacgtcacggtaaggtgccggttcggcgatggtcgcaccgttcagcgcccgctgggcaatcgggaagagcgtatcgttgatcagggtcgatttacccgagccggaaacaccggtaatacaggtgaacagcccgaccggcagcgtcagcgtgacatccttgaggttgttgccgcgtgcgccggtaatcttcagtactttggccgggtcgcctttgacgcgctcctctggcactgcaatgccacgcttgccgctcaggaactggccggtcagtgacgcttcctgcgccatgatctgatcaaccgtgccttcagccaccacctggccgccatgtacgcccgcacccggaccgatatcgatcacatggtcagcggcacgaatcgcatcttcatcatgctcaaccacgatcaccgtgttaccgaggtcgcgcagatgaatcagggtgccgagcaggcgttcgttgtcgcgctggtgcaggccgattgaaggctcatccagcacatacatcacgccgaccagaccggcaccgatctgactggccagacggatacgctgtgcttcaccaccggacagggtctcggcggaacgcgacatcgaaagatagttcaggccgacgttgaccaggaagctcaggcgatcgccaatctctttcaaaattttctcggcgatctgcgcacgctggccgctgagtttcatgttttcaaagaaggacatcgcatggccgatgctcatctcagagatggtcggcagcgtggtgttctccacgaagacatgacgcgcttcacgacgcagacgggttccttcacagctggcacaggcgcggttgctgataaatttcgccagctcttcgcgtaccgctgaggactcggtctctttgtagcggcgctccatgttattgagcaccccttcaaatggatgacggcgcaccgaggtgtcgccgcgatcgttgatgtacttaaattcgatgctctctttgcctgatccgtacagaatcactttctgtacgttttctggcaggctgccgaacgacgcttcgatatcaaaatcgaggtgttccgccagcgaacgcagcatctggaagtagtagaaattgcggcgatcccagccgcggattgcaccgcccgccagcgagagttcaggattctgcaccacgcggtcagggtcaaaatattgctgtacgccaaggccgtcacaggtcggacaggcgcccgccgggttgttaaacgagaacaggcgcggctccagctcgctcatgctgtaaccacagatcgggcaggcgaagttagccgagaagagcagctcttctgcggcgctgtcatccatgtccgccacgatggccgtcccgccggagagctccagcgtggtctcaaacgattccgccaggcgggttgcgagatcttcacgtaccttaaagcggtcaatcaccacttcaatggtgtgcttcttctgcagctcgagttttggcggatcggagaggtcacacacttcgccatcaatacgcgcacggatataaccttgcgtcgccagattctccagcgttttggtgtgctcacccttacgatctttcaccaccggcgccagcagcatcaggcgacggccttccggctgggagagcacctgatcgaccatctggctgacggtctgcgccgccagcggcacatcatgatccgggcagcgcggttcgccaacgcgggcaaacagcagacgcaggtaatcatggatctcggtgatggttcccacggtcgagcgtgggttgtgtgaggtggatttctgttcaatggaaatggcgggcgacaaaccttcgatatgatcgacgtccggcttctccattaacgaaagaaactggcgcgcatacgcagagagcgactccacatagcggcgctgaccttccgcatacagcgtatcaaacgccagtgaggatttaccggaacctgacaggccggttaccacaatgagtttgtcgcgtgggatggtcaggttgatgtttttcaaattatgggtgcgggcaccacgaaacttcgatcttatccattcacctttcccggattagcagcactcaccgcgccttgccgacacggccagaataaacgtgtcattatggcacaaaaaatagactgaataaatatccagtactcttagcctctggcgcgcagagtattaaaactggaaccccgctcgaaagtgggaaacagaccgcaggacgtgttagaattgatagattagactgtatgcattaactcatcgggagacagcaacatggccagtcgtggcgttaacaaagtgattcttgtcgggaatctgggtcaggatccggaagtacgttatatgccaaatggtggcgctgttgccaacattacgctggctacgtcggaaagctggcgcgacaagcagaccggtgaaaacaaagagatcactgagtggcaccgtgtggtgctgtttggcaaactggctgaagtcgcgggtgaatacctgaaaaaagggtcgcaggtctatatcgaaggccagctgcgcacccgtaaatggcaggatcagggtggccaggagcgttacaccaccgaagtcgtggttaacgttggtggtaccatgcagatgctgggtggccgtcagcagggcggtaatgccggtgcaggcgctccagccggtggtggcgcgcagggcggtggcaacaacaatggctggggtcagccgcagcagccgcagggcaacaataaccagttcagtggtggcgcgcagtcccgtccgcagccgcagccacagagcgcgccggccagcaacaacaacgaaccaccaatggatttcgacgacgatattccgttctgattccgttggccagagagtacaaaaaaagcccgctttgcgggctttttttatgcgcggcgtctggcggccagctacgaccattccgccagaatcgcctccgtgctcagcacacgtggcacgttgccggggatcagcagtgaggcccacacatcattgtgctggttaatcagtgcttcggcgctgacccagcggcgatctgccgtggtgtgcgcatcggcggcaacggtaatcgcatagcccgcactggcaccgacttttatcgtggtatccaggcagtagtcagtggcacaaccgcacaccacaaattcctctaccgccagcctctttaacagcgtggccaggtcggtgtgccagaagctgtcgcaggcagttttggtcacatagtgtgcgccagcaggctgagcgatttccggcagcagcccgaaagccgcattaccctcgcacatctcgccttcgcggtgctggataaatattgtgatatcggcgcgttcggtcagccggttaatctgtgcaatccttcccgctgtgtcgaagcgtggcgtgctgaagacgccattctgcatatcaatgaccacgactacccgctgtgccatgcttaatcccatccggtttgaaaaaagcagtgttacctgaggcattgcggaaagcaatcttttgcattttcccccctgtcacaggcatgctaaaccgactggttaaataaggagagagaagtggaaggtgttccggcgagttttccctgtgagaaagaccgcgcccggtttcagcaactcgccgagctgcccggtgtggaactctatcaggcccacatctcccgctacgcatttgaaccccatacccatgaagcctttggtatcggcaccattgaagcgggtgcgcaacgctttcgctaccgcggcaccgaatatactgcgccggagaactcgctggtcatgatgaatccggatgagctgcataccggtgagtcagcgtgtgaagagggctggcgctaccagatgatctacattcagccgcagctgatggatgaactgaccggcgatcgcggctggtggttcaacgaggcgctgttgaccgatccgcgcgtggcgcggccgctctcccgcacgctggcgacactctggcaggcggaatcaccactggcgcgccagagcctgctggctgaactgctgttgcagattcgtccgctggcacgcatgtcctcacagggcagaccggatgcacggcatcgttttgatcaggtaagagattttctgcgctcaaacctcgcagaaccggtgcggctggatgagctggcggcgctggcctcgctctcgccgtggcacttcttacgcgcctttcgtcagcactatcacgttacgccgcatcagatgctgatggctttccggctttacgacgccaagcaaaggctggcacagggtgaagcggctgccagcgttgcggcggcggtgggattaaccgatcaggcccatctgacccgcgcctttgcaaaccgttatggcatcacgccgggccgctatcaaaagcaggtgcgccagccctgataccaccgcaatctgctacaagcgttccccgcccgaacccgccacactgaacgaaaaagctatataaggaagaaattatgtttgctggtgtcatgtttgccgtcaccgccggactgctgtgggggctgatctttgtcgggccgctgctggtgcctgactatcctggcgcgctgcaatcggcgggacgttatgtggcgtttgggctgattgcgctgccgctggcctggcacggtcgtcatcgcctgcgcaagctggcccgggctgactggcgtgaagcggtaaagctctcgctggtgggaaacctcttctactatgcgtttctggcgaacgccattcagcgcactggcgggccggtctccaccatgattatcggcacgctgccggtggtgatcgctgtgacggccaatctctgttacggccatcttgaaggacgcctgccgtggcggcggctgtttccggcactggtcatgatggcggccggattactctgcgtgaatgcggcggagctacagagtcagggccacacccttgatctcagccgttatctgaccggtatcgcgctggcgctgctggctgtggtctgctggacctggtatccgctgcgcaatgcccgctggctgcgtacacatcccgaactgcggccctcgacctgggcaacagcgcagggagtcgtgacgctgccgatggcgctaatcatgtacgcgctggtcagcgcgcagctcgcctggcaacagccggctttttcgctgccgtttgggccgcgtcctgcagtgtttatctccctgatgctggcgattggtctgctctgtttcctggctcgggaccttatgctggaacgctgccagccagcgtctgcccaccgtactgatggggccactgattgtttttgagatccttttcggcctgttgtggacttttctctggtatcaaagctggccacccctgctcaccgtgacggggattatttgtctgatggctggtgtcctgtgggcaatgcgcattaaaccgcagcctctcgtcgtcgcgattaaagagtaaaccgcgaagatcgccaaaagacctctgccgcgcggataacacgccgcgcggctttttaagattaaaccctaccccgatttgctcgctctccggcagatttgtgccgcgaaatcgatttcatgcctctgcgtaatcgtaccttaactcccgaaagcctctttcatcccctgtttgtcagtgaaaaaacgggactgatggtctcctgaacatagccatgtttagcgttgccagggaggaactgttcagatatcggtcattaatcaggaaaaatcgcgcagcattatggacgttatgcttttatcagcggctttttattgcggtatggtcctgagaaagggaggctgaaaaccactattaacttcactcagtgatgaatgagtaagaaaactccgccgctgcgttaataattaaagattaatctctggcatcaatgatgcgcaatgaagagagcgaaaagatagacacataacgttagtgataaggagcaataaactatttatcctggattaatcctggagaaagtatatgccattaacccattccccggaattaaacgcagccgcaaaaatttgagtcaggtccagcattaactcaaatatacggtgattgttttttgcgcgatgtttaaattggcttaatgatattgagacgatttagttccgacgattagctgggcttacgtaagaaagggagggcccaatcccgcgtaaacgagattgggaagggaagaatagccgtataatgcgagacgtttgctgttgtgaatcaattttaccgcaaaaaaagaagcttagccgtgaagccattcattagttataaatggagcggaaaagggtgccgcaattgtcctgttaaatgatcttcatctcttctggtaagaacaaatctcagcgttaagtctaaaaagcgcggtagcattggggtttagcggttctccgtgcctgacggataatggtatacgctgcgactgatatctaataagcggcagctgcgacgggtgccgatgtcaaaggtggcctgcaggaaatccacagcctgacgtttttcattagtggtaaagaagtgcttcagaacgctctgcagcatctctttgtccgagttgagcgtctgcagttcacgcgtgatgttctgcagtttttcttccagctctttgatttttctgccttcttccgaagacaacccagaaaacttcttcttccagctgtagaacgtggcttcagagatgcctaactcttcacaaatctctctgactttcacgcccgattcagaagctttaatggcatttgtgatttgatcttcgctgtatcgtgactttctcataaatgctcttacctttcttatcgattaatggatgagaatgactttaataatttctggcactgtaagattctattaaggcagtattaaagtgcgcgaattgaattgcgaagcctaaattaagatatttagaataaatatcatcatgggataaatcttattttattcttatccggtgggcgtgccttcctggaggggggtttttgttataaattcatcgcatccaaaatacgaaaaaattctacgtacattggatatttagcctgaccgacttgattaatatggcgggaagggctcttaaaggttgttttattttcagcctgaaatcgtttccatctgaagtgattcgcgccatttataataagaattatcctgaattaacactccggatcatgatttacatctcaattttcggaccagcttggtctgaagtcttacattttcgccaggcccactgagcgcttattaattcgttacagggatgttgtaccgaagcggttgtagttgagtaatactaaggaagagtcgatgaaattgagcgtaatgtctaatgccgcctggatgatgtctgagaagatcatctccgtttttggcgtcatttttgtgacgtcttacgtggcgaaatcctttggcccaacggtgtttggccagatggcgttttctacttcactatttgcgatggtgcaaaccgttgcaatctttggcaccgaaaccattctgtttaaacgcgtcagcaaaaatgcgtcaaaaggcctgcgcctgatgaccatcgcccgcacgatgagaatggtgctgttgctggtcacttcggtgccagtcttaatctgggtctggtacaacatgcaggaaaatttcctggcgtttgcactggcctcatttgttgcctcggtttttgtcacccaggacaccttcagcgtttataacaacgcgcgtcttgcctcgcgtcttaacaccatcgccaacgccgtgggcatgctgctgagtttcggcatcagcttcaccgtcgcctggctgcgtcttaatccgctctggctgacgctgtcgattgtcgcagtgactctggtgccttacctgattaagcgtcacaacttctatcaggaccatcaggatcagatgccaccacgcgaaaagcgcacggcctatctgcgttatctgatgtatgccggtctgccgctggcgatctccagcatctttatctctgtgcaggtaaaagcggcgcagatgttcctggcaggcacggcacccgcgcgcgacctcgggctgtttgcggcggcgaataccatttccgcctcatggatttttatcccggtggcgctcatcacctcctgcttcactgaaatcttcagggagcgcggcgaggtcgccattaagctggctgcgcggctcaatggctatgttatggcggtttcattgctgatgctgctgatcatttcgctttatggcgagcggatcatcattgcgttgtacggcccggaattcacacagtcaggaagtctcattacgttgctgtcgatagcgaccagcttttcggcaatggggaccgtagcgtatcgctacatggtcaaagagggaggatttaactacttgctgaggaaaatcatctgcctgatggtcatcagtttgccgctctcctggtggttgatccagggtcacggcatcatgggggccgcgtggagcgttttcctttcagaacttttgtccctgaccgtaatgaattacttctttaaaaacggcgtcattcaaaagattcaggtttcctcactcaactacaaaacatacaaatgaggtcagatatgctcaagttgaaagaagaactcagaagaagtgtgcagtattttattaagaagatgccctgggcttatcaggaccgcatctactacttccataagttcagaaagctgcccaatctgcgtcagccaaaagtgttcaacgagaaggtgttgtaccgtaagtttatcttcggcgattaccagagctatggtcgtctgtcagataagtactcggtgcgcgaattcattgctgaaaaaatcggtaatgaatacctgatcccgctggtacacgaaacgactgacccgaccacgctgaacagcttaccctgctggaaggggacggtgatcaagccgaaccacgcctccaacatggtagagattctgctggaggagccggacgcactgcgcaagcagcagatcattcatgactgctatcgctggctgaagaccgacttcgccaacgaagcgcgtgagattcactatcgctacatcaagccacgtatcctggttgagaagtacattggtgatggcaaaagcgcgccgattgattacaagtttcatatgttcaacaagcgtgatggcaagttcgaatatgtgctgcaggtgatctacaaccgctgccagccgctgctgtcgatgaatttctacgtgaataacctcaatgaggcctatcacaagattcgcgataccggtctggatgtctcaccgattatgccgtcactggaacatgcgctcgaactgagcaagaagctggccagtgatttcgactacgtgcgtgtggactggtatatccatgacgagcggatctactttggcgaaactgaccttcaccccaggtgcaggactggtcaccggattagatcgtggtttaaatcagatgatgggagatatgtggattcaggaccgccgcggaacgcagagcccgggcgttacagtgcaggatgttaatattcctgccatgttgaagaaaatttaagcacacacagcaatataaaaaaccccgcttagcggggttttttatgcgcaaaaatcagggcatcggccagtcagcaggcgcctggctcatcacatcgataaaggcatgctttgagatttccagaaagttatgcacgttatccatactcagggtaatgcccatcagaccggtaacaaaccagcaggtcatgcctaaaccaatcccgccacacataaatgccatcacgtgacggctatcctgacgaagtttggttttcagggtgctggcaaaaaacatcatgattgcgctcagcaattcccaacgcataacaagtaaactggcggttaacgtagccatcggccggacctcaatatcagtaagtattcctgacaatctgcggacatcaccggcggcggaaaagtgtgtcagggggtgctttttcgccgtcaacccaggttcaaagtgtgatttgggtcacattatatcacccgattttaaattttgaacaaaatttgactctggtatggtagcggcgtgagggaatagtgagcagtagaagaagaacggcggggaaatcagtcagatgcgcccgggcgggcgcatctgaggggtcaacgaaccggacagcactcgccggtcgtgcgctgggtgaagctactgataccgtcattgcagccaaaactcagcaggcgagggcgctgaatcgcctggcggcgcatggtgtggcggtaagcggtaggcgtctgtgaaaactgacgacgaaacacgcgggagaaggtctgctgcgagtcatagccatactgcatcgcgatatcaaaaaccgggcgctgtgtctgtgacagcgcttccgctgccagcgtcagacggcgctcgcgaatatagccacccagcgtctgtttcgttaccgaacggaacatacgctgcagatgccatttcgaatagcccgattttgcggcaacctcatcgatcgacaggctcttatccaggttctggtcaatccagtgcgtcagggaatgaatgatctcttcttgcatcatggtctcatccttctggtgcttaataagcggtaatgggagtttagtggttttgatggagagcgagtataattcctcaagttaacttgaggtaaagagcctgatgaaaaaagaacgcaactatccgaaaccggtcttaacaccgggtgaagtggcgcgccgcagcggtgtggcggtttcggcgctgcacttttatgagacaaaaggacttattttcagcacccgcaacagcggcaatcagcggcgatatagccgtgacgtgctgcgacgcgtcgcaattatcaagattgcacagcgtatcggcattccgctggcaacggtcagtgacagcctggatcacattccgcctgacaagcgcatgtcgacaccggagtgggatgcgctgacgcagcactggcgcgaagagctggataagcgcattgaaaccctgacccgcctgcgtaatgacctggatggctgtatcggctgcggctgtttgtcgatgcgcgactgcccgctgcgcaatcccggcgaccggctgggtcagcagggctcgggtgcggtgctgcttgacccggaacaggatgataaacatccggatgtagagtgacgtctatacttggtgaaggtcaaaacacagggaatcatgatgatcaccgttcaccatcttgagaaatcgcgctcgcatcgggtgctgtggctgctggaagagctggaagtgccgtaccagattaaacgctatcaacgcgaaaccgaccatgctggccccggaggcgctgaaaaaagtgcatccgctgggaaaatcaccggtcattaccgacgggaaccaggtagtggcagagtcaggtgccattctcgaatatcttgaagagaaatatgatcacgagttccggctcaaagtgagtgatgaggcatcacgactgcagtgccgctactggctgcactatgccgaaggctcgctgatgccgctgctggtgatgaagctgatcttcggtcagatgggtaaagcaccggtgccgtggctgctgcgtccggtcggggcggcattcggtaaaggcgtgcagaaagcgttcctggataaacagcttaagccacacatgcagatgatcgaacagcatctggctgcaaatccctggttcgccggtcagcgcttcagtatcgctgatatccagatgagctttccgctgctggcgcttgcgcgacgtgccggactggagcagatgcccgccagccagaaatggctgcagactgtgcaacagcgtgccgcctggcagcgcgcgatcgatcagggcggcgagctttcgctgccaggttaattcccctcttccactggcgggtcgtgtctcatcacggctgcgccggtgcgcatccccctgaaaatcgcgttaacttcagggcgtcagcgtttgacgtcggcttgggccacgtggctgctggccacttaagcctgatctttatgctgaagaatctccctctgacagttgaaaatgtgccgctaaacgccggataatcgcatgcctttttatctggccgcttctggcggccaactatctgcggcaaggtaaacgtttgcctgccgggtaaaacccgacagtgacgccgtctacccgcttattccagggacagcgatggtcgcagagcgatccacacaacaaaaatttttgaggctcaactatgtcaactgaatcacgcccggccagtggaaaactggacgcctggttctcgatctcggcgcgcggcagcagcgtgcgccaggaaattctggccggacttaccaccttcctggcgatggtctactccgttatcgtggtgccgggaatgctgggcaaggccggttttccccctactgccgtgtttgtcgccacctgcctggttgccagctttggttccatcattatgggactgtgggccaatctgccgatggcaattggctgtgcaatctccttaaccgcctttaccgctttcagcctcgtgctgggccagcacatcagcgtgccggttgcgctgggcgcggtgttcctgatgggcctgctgtttaccctgatctcagtgaccggcattcgagcctggatcctgcgtaacctgccgatgggcgtggcgcacggcaccggcgtcggaattggcctgtttttgctgctgattgcggctgacggtgtaggcctggtagtgaaaaacccggcaccgggcctgccggtggcgctgggccacttcaccacttttccggtaatgatgacgctgttgggactggcagcaattattggactggagaagcgcaggatgcccggcggtattctcatgacaattatcgccatttcgctgctggggctgatcttcgatccggcggtgagctacaaaggattgtttgcgctgccgagcctgcgtgatgccagcggtgagtcgctgctgttcagcctcgacattatgggcgcgatgcagccggtcgtgctgccaagcgtgctggcactggtgatgacggcggtctttgacgcgaccggcaccattcgcgcggtcgcgggtcaggcaaatctgctggataaacagggccagattatcaatggtggtcgtgcgctgactagcgactccgtcagcagcctgtttcgcgggtctggtgggcgcgtcaccggctgcggtttatatcgaatcggcggcaggaacggcggcggggggtaaaaccggtcttaccgcgattgtggtcggcctgctgttccttgccattctgtttatgtcaccgctggcgtatctggtgccggcttacgccaccgcccccgcgctgatgtatgtgggtctgctgatgctgagcaacgtggcgaaagtggacttcaatgattttgtcgatgcgatgtcgggcctgttaacggcggtgattatcgtgctcacctgtaacatcgtcacgggcattatgatcggtttcgccagcctggtcgtggggcgtctcttcgcgggggaatggcgcaagctcaacgtcggcaccgtcattattgctatcgcgctggtggcgttttacgccggtggctgggcgatctgactgtacaaccgggcgtgcggctgcacgtccggaatttttcactattttcccgcccggcgcacgcgtagctgacaatcttcaccgcagtttgttttacactttagcgcttaaccaatgattgaaagaaacgacgcctaaggaaagcatggaaatcttttttacaattctcatcatgacgctggtcgtgtcgctctctggcgtcgcggctcgtatcctcccttttcagatcccgttgccgctggtccagatcgctgttggtgcgatgctggcctggccaacttttggtctgcatgtcgactttgacccggagctgtttctggtgctcttcattccgccgctgctgttcgcggatggctggaagacgccgatcagtgagttcctgcatcatggtcgcgagataattggcttagcactggcgctggtcctgattaccgtgatcggcatcggctatctgatctactggctggtaccaggtatcccgctgatccctgcctttgcgctggcggcggtgctgtcaccgaccgatgccgtggcgctctcaggcattgtcggtgaaggccgtattcccaagaagattatgtcgatcgtgcagggcgaagccctgatgaatgacgcttcgggcctggtatcgctgaaatttgctgtggcagtcgccatgggtaccatggtgtttacctggggcggtgccagcgtagagttcctgaaagtggcggtgggtggtctgattgcgggtgtcgcgatctgctggctctacggtaagtcactgcgcctgctcagccgctggagcggtgacgatccggctacccagaccgtactgctgctgctgctgccgttcgcctcttacctgattgctgaacatctgggtgtctcaggcatcctggcggccgtggctgccggtatgaccatcacccgttccggtattattcgtcaggcaccgctggcgatgcgcctgcgtgccaacagcgtctggcagatgctggagttcgtctttaacggcatggtcttcctgatgctgggcctgcagttgccggatattctgcagacctctgttgatcaggcgcaggccgatccgaacgtcgagctctggatgctgtttgccgatatcgggctggtctatgccgcgctgatgatcgtgcgttttggctggctgtggattatgcagcgcttcagcaaacgcctgctgaagaagaagccgctggagttctccaactactcgttgcgtgaactgctgatcgcctcctttgcgggtgtgcgcggcgcgattaccctggccggtgtcctgtcgattccgctgttcctgaccaacggcgagcctttcccggcgcgttatgaactggtctttatcgccaccggcgtgattctcttctcgctattggtaggggtagtgattctgccgattctgctgcgcggcattgatactattgataaaggcgcacaccgtcgcgagttgcagaatgcgcgtgcggtaatggcaggcgcagccattgagagcctgcacaagatggaagagcggctggagaatgagtcggaagagaacatcgatccggagctgcttaaagaggtgagtctgcgggtgattggcaacttacgtcgtcgcgctgaagggaagaatgaccttgaacacgcgctgttcgccgagaacctggagcgtcgcttccgcctgaccggactgcgtgccgaacgtgctgaggtctatcatctgcgcgccacccagcaaatctccaatgagacgatgcagaagttactgcacgacctggatctgctggaagcgctgctgatcgaaaaagaggagtaagtcctgactggcacgcctgcgcgttaatgcggcgtgccagcctttcacaccgacaggcgcggcggctcatccggccaatgctcgcgacaacaggctatccacgcctgcgcactgcgcgacagataactcccttcccgccagatcaatcccagactccacttcagctccgattccagcggcagccacagcagcgactgcttatccagccgctgacagatcggctccggcagaatcgccagccccatctccgcctgcaccatcgccgccagaaaatcccactgtccgctgcgaaccgccaccgttggcgtcaggttgagcctctgaaacgcctgcatcagctgacgattcagcgagaactcctcattaaaaatcagcagtggatgctctgccagtttctgccagtccaatctgctggcggctgagccactccgggcgacgcggcagcagtacgcagagcggatgatgcatcaggggcagggtgttcagcggcagctcggcatcgaccggtagcgcggtcagggcgatatccagactgcccgccagcaccgcctgctggacggtcagaccgccgaactcagagattttcagcttcacaccgggatagcggcggcgaaacgcggaaatcgaaccggcaatctgcataccgaccatcggcggaatacccagtcgcagctcaccggttttgagctggttgatgtcaccaatctccgcttccagctgatgaaactcctgcaggatcgccaggccgcgttgatagaccgcctggccgctgtcggtgaggtgcagacgacgaccatcgcgcaggatcagcgtgcagcccagctcctcctccagctggcgcagcattttgctgatggtcggttgtgtcacaaacagcttctgcgccgcacgggtaaagctctgctggcgtactacttcagtaaagtaacgcagggcgcggacatccataactattcctttcaggcatgatttcgataattttaattcatttttttcaccttctgttgacgatttatactggtgacatcaatttaatcggggagacaaggtgatggcgttagcgctcactttacgcagcaaccgcgcagtgcaatggctcagcctgccgctccagctgggtttctatatcggcctgtttatcgcctgcgaccggctggtaagctggctgcatctgccgctgcccgccaatatcgtcgggatgctgctgctgctggcgttaatcgtgacgcggattgtgccgctgaactgggtgaaagccggatcacgctggctgctggccgagatgctgctgttctttattccggcggtggtagcggtggtgaactatggcgatctgctgcgggtcgatggctggcgcatctgtgtggtgatcggcgtcagtacgctgctggtgctggcatccaccgcctgggtggtggatcggctgtatcagtatgaagtcgcgcgcgccgcgcgtaagcaggatccgcatgcgtgattttctgctcagcctgctgtgtgtagccgttacgctgctggtttatgcactgaataaacggctttaccgccgctggcggacgctgctgctgatgccactggtgatgacgccgctggtgctggtggcattgctgctgctgacgcatatcagctggcaggattacatcgccgaaaaccactggctgctctggctgctggggccggcgacgctggcgtttgcagtgccggtctatgagaaacgtggaaattattaagcgccactggctgtcgctgagcgcgggcgtagtgaccgcgacgctggtcgccatctgcagttccgtctggctggcgcggctgttaaccctgccggagtcgattcagcgcagcctggccgtgcgctctatcaccacgccgtttgcgctggctgcggcgggtccgattggcgggcagcccgatctggtggcgctgttcgtggtgattacaggcgtgtttggcatggcaatcggcgacgtgctgtttctgcggctcgccattaagcagggcgtggcgaaaggcgcgggatttggtgcggcgtcacacggtgccggcacggcacgcgcctatcagattggcgagcaggagggcgtggtcgccagcctggtgatgatgctctctggcgtggtgaccgtggtgctggccccgctgattgggcacctgatgtggacaatataggctacactccgtcgcacaggggctggtctgcgctgagacacgtatttttacgtaaagttttccagattttgttgtctccccatttcaggctgttaaccttgcggccgaattaattgtcctttcacggagtggaatcatgtttaagcaacttgttgccgggagcgccctcgggctggttttaatgagcggtgccgctcaggcgattgaaggcagtgttgatgtcagcgaacataacaccaacctgaatgtgggtctgggcaccacaacacccggtctgtttctgaaaggtaactggctgcgtagcgaccatgacggcagcacctacggtgccggtctgggttacaacgttgatttcgggccgctgcgtctggcgccgaccgcaaaagcgatcttcacccatcctgaagatggaaaagatggatttgcggtggcgctgggtggtgcagcacactacagcttcaacagcatgtggggcctgtatggcgaatattattacgcgccagagtctttcaccgatcagctcgacagctatcaggaagccggtggcggcctgagcttcacgccggtttcactgcttaacctgcgtgtgggttatcagtacatcgaactgaacaacaaagatggacgcaaagataacgtgctggtcgatggcccgtacgtgggtgcatcgctgcgcttctgattctgctgcgcaaaagaagagggcgactacttcggtagccgcccttttttattgcctgctcgttatgaacgaaaagccacgatcagtgcgctttgccctgttcgatgccggtgccggtctgcgagcggataaactgtgcacggaagcgtgaacgttcttctgcgccctgctgcgaatggtcggtaatggagaagagccagatgcccacgaaggccaccgccatggagaacagcgccggatactcataggggaaaatcgccttcgcgttgcccagcacctgtacccacaccgtcgggccgaggatcatcaggataacggcggtcagcagaccgagccagccgcccaccatcgcgccacgcgtcgtgagttttgaccagtacatcgacagcaggatgatcgggaagttacagctggccgcaatcgagaaggccagcccgaccataaaggcgatgttctgtttctcaaacagaatacccagcgcaatcgccaccacgcccagcgccagcacggtaatttttgaaacccgcagttcatctttctcgctcgcctgacctttacgatacacgctggcgtagaggtcgtgagacaccgccgacgcacctgccagggttaagcctgcgacaacggccagaatcgtggcgaaggcaaccgcagagataaagcccaggaaggtgctgccgcccacggcgtttcgccagatgtaccgccgccatattggtgccgccaatcagcgcgccgctggcatctttaaaggccgggttagcgcccaccagcaggatggcaccgaagccgataataaaggtcaggaagtagaagtagcccataaaaccggtggcccagaagacgcttttacgtgcctctttagcatccgctacggtaaagaaacgcatcagaatatgcggcaatccggccgtaccaaacatcagccccagccccagagacagcgccgagataggatctttgaccaatccgccaggctgcataatcgcgatgccttttggatggaccgccatcgcttcggtgaacagcgtattaaaactgaaaccggtcgccttcattaccatgaccgccatgaaggtggcaccaaacagcagcagcacggctttgatgatctgcacccaggtggtggccagcatgccgccaaacagcacatacatcaccatcagaatgccgaccaggactaccgcaacatggtagttaaggccaaacagcagctggatcagtttacccgccccgaccatttgcgcgatcaggtagagcgccacgaccaccagtgagccgcaggctgacagggtgcggatcggcatctgcttcagacgatatgaggcgacatcggcaaatgtgtagcgacccaggttacgcagtctctcagcgattaaaaacagaatcatcggccagccgaccaggaagccgagcgagtagatcagcccgtcataaccggaggtgtaaaccagcgccgatatgcccaggaacgaggcggccgacatgaagtcacccgccatcgccaggccattctggaagccagtgatattgccgcccgcggtgtagtagtcattacgtgatcgggtgcgctttgaggcccagtaagtaattcccagcgtggccccgacgaaaatcgtaaacatgatgatcgcctggtagttggtcgcctggcgctgcacggcaccggttatcgcatcggcagccagcgctgaaaacggcagcattaaggccagcagccataaggtgagacgagtcatgatttcacctcgctgaggatcgctttcgttaaacggtcaaactcaccgttggcacgccagacatagacgccggtcagcacaaacgacatcacaatcagcccgaccccaatcgggataccgcgcgtgacgttggtgccggcatgcagcggcgtaccgagccagccgggtgcaaatgcaatcagcaggataaagccgacatagagcaccagcatgatcagcgacagcagcgtcgcgaacgcctggcgcttacggactaattcatgaaaaaggggattacgctcaatctgttgattgatggcatcctgattcgaaagggcgtcattcatcacattttctccagagggcttgcaggcgagaacctcgcgacagggcgcggattcagctggttataatatttgtgactaccgaaacagactgcgtagggcgggtgtggcgggaagcgatcttcccgccggacagcgtgcgcttaaggcattttgatcgactgtttctcctcaagcagtttttctactacgccaggatcggcgagcgtagaagtatcaccaagattactggtatccccggtggcaattttgcgcagaatacgccgcatgattttgccggagcgggttttcggcagtgagtcggtccagtgcagtacatccggtgtggctatcgggccaatctctttacggacccactggcgcacttcggtgtacaactccggcgacggctcttcgccatgattcagcgtgatataggcataaatcgcctggcctttgatgctgtgcggaatccccactaccgccgcttcggcaattttagggtgcgagaccagcgccgattcaatttcggcggtgccgagtcggtgaccggaaacattgagtacgtcatcgacgcgtccggtgatccagtagtagccatcttcatcacgacgggcaccatcaccactgaagtagacatttttaaaggtagagaagtaagtctgctcgaaacggtcgtgatcgccatagagggtacgtgcctgacccggccacgactcggtgatcaccagattgccttcacaggcgccttcctgtggctgaccttcgttatccaccagcgcgggctgcacgccaaagaaacggtcgggtggcggaacccgctttcagctcggtcgcacccggcagcggcgtgatcatgaagccgccggtttcggtctgccaccaggtatcaacaatcgggcagcggctgttgccgattttcttgtagtaccactcccaggcttccgggttaattggctcaccgaccgatcccataatgcgcaggctgctgcggtcggtgccggcaatcgccttatcaccttccgccatcagcgcacggatggcagtgggcgcggtgtagagcagcgtgactttatgtttatcgaccacttccgccatacggctcggagttggccagttcggcaccccttcaaacatcagtgtggtggcgccacaggccagcgggccataaaccagatagctgtggcccgtcacccagccaacatcagcggtgcaccagtagatatcatcctgatggtaatcaaagacgaacttaaaggtggtcgcggcatagaccagatacccaccggtggagtgcaacacgcctttgggtttgccggttgaaccggaggtataaaggataaacagcggatcttccgcgccgacttctgcggcagcgtggttggtgctcgcgttcagcatcaggtcgtgccaccactgatcgcggccctcaacccagcccacatctttaccggtgcgctggaacaccaccacatttttcacgctggtgacattaggattttttaacgcgtcatcgacatttttcttcagcggaatgctgcgaccggcgcggatcccttcatcggccgtgatcaccagcgaggcgctggaatcgacgatgcggcccgcgaccgcctctggtgagaaaccgccaaagatcaccgagtgaacggcaccgatacgcgcacaggccagcatcgctactgcggcttccggcaccatcggcatatagatcgccaccacgtcgccttttttcacttccagcagttccagcacgttggcgaagcgacagacttcggcatgtagctggcggaaagtcagggttttgctttcgctggcgtcgtcgccttcccagataatcgccgggtgatcgccgcgcgtggctaaatgacggtcaaggcagtttgccgccaggttgagcgtgccatcttcgtaccagcgaatgttaatgttacctggtgtaaacgagcagtttttcactttgctgtaaggcttgatccagtcaaggattttgccctgttcgccccagaaactgtctggatcgtcgacagattgctgatacatcgcctgatactgttctgcagtaatcagggtgtttgctgcaatattctctggaacgggatgtttgtgtatttggctcatggcggatctccttgaagatgttaatgatatgtcaatcaatggttaattaaagcctgcgccaaagctttgtttcttttttgcgccacagatcacgtgatacacatcccccgagaagcgttaagccattctgatctatcaggttaacgctctggcggcgctggagaagtcaggcatcggttttacgctttcatcctgaataaaaagcgagcaaacgcgccggatcagtttttaatcgtttctgcatagctatgcgtaaattcatcgaagtaatacttttcataacagcaggttagggtttttcagctctggcagcactttatgctgcttagatggtgaacttttaatcggatccgccaggggttgcatttaccacagtgaaaatggtacttatctcgcccctgttctgcaggtatcaactcagaccgcgtctgaaaatgggtatgggaatcatcagattttcatacgaggcgctgtttcaagacaccctctaatttaccgggctttttgctcactccctgtgtgtattgtcttctgcaccttcgcagtagagagaaacgggttttgactgaggaaattacacgttatgaaaggttttaaaatcagcctggcctggcagattctgacagccctggtgcttggcatcgttgtgggtgctgtgttgcataatcagccagacaatcgtgaatggttagtcaccaacattctcagcccggcaggcgatatctttattcatcttatcaagatgattgtggtaccgattgtgatttcatccctgattgtcggcatcgctggcgtgggtgatgcaaagaagctgggacgcatcggcgtcaaaacgattctctactttgaagtgatcaccaccattgccattgtggtcggtattacgctggccaacgtatttcaacccggcaccggcattgatatgtcaacgctggcaacggtggacatctctaaatatgaagcgacaacggcagaggtacagggcggtccgcacagcctggtcaccaccattctgtcgctgatcccgcagaatattttcgcctcaatggcgaagggcgacatgctgccgattatctttttctcggtgctgtttggtttaggcctgtcgtcactgccgtcagaaacagcgcgatccgctggtgaacctgttccgtggcatttctgaagcgatgtttaaagtgacgcacatgatcatgcgctatgccccggtgggtgtgtttgcgctgattgcagtgacgattgctaacttcggctttgcctcgctctggccgctggctaagctggtgttgctggtttacgcggcaattctgttcttcgcctttgtggtgctgggcggagtggcgcgcttctgtaagctgcggattaccacgctgatgcgtatcctgaaggatgagctgattctctcttactctacttccagctcggaaacggtgctgccgcgcattatggagaagatggaagcctacggcgcgccgaaagcgatcaccagcttcgtggtgccgaccggttactcgtttaatctggatggttcaacgctttatcagagtatcgcagcgatctttattgcgcagctgtatggcattgacctgtcgctgaccgacgagattgtgctggtaataacgctgatggtgacctcgaaaggtatcgctggcgtgccaggcgtctccttcgtggtgctgctggccacgctgggcagcgtcggcattcctctggaaggtctggcgtttatcgccggtgttgatcgcatcatggatatggcgcgtaccgcgctgaacgtggtcggtaatgcgctggcggtgctggtgattgcccgctgggaaaaccagttcgacgtcgaaaaggcgaaagagtatgagctggagctgcggacacagaccgcaagctgaacacggcattaacgtaagaatgggctcaacgaaagttgggccttttttttatgagatttttcatggcagatatacaggttgactgaaaattaaaaggttatatttttataactaaaaaaccataattatgagacgatagtattgttattatgattgattatagttatatttcgttgcggtaagttgactgtcttctttgacaacatggagtgttgacggatgccagaaattaactggacgaaaaaggcattgaaacagctttatgggctgcctcagaaagagggtaacgctattgaagatgctgtagaggcgctggctaaatggccggatattccccatctgaaagtcgaaaagctgactgatgataaacagaagcgaatgaagctggtagtaggtcactaccgcgtactctggaagatagagaaaggtcagccagtagtgatagatatacttgaagtcgtaagaagaacatcgaccacgtacaaaaagcgctagcagtgtggcaggagcaatgtgcgtcatcaataagttctgtgcagccgggtttagcgttccgcagcacaggcagacgatcagacagtttccgcagcacaggcagacgatcagacagtgttgcctgccgtaccactaaggagtgattacccatgaatgctatacagtttctgacggacgagcgcgggaaccgcactggtgctgtcatccctatagagctgtttaataagctcatggctgaacgtcatttagatgatgtgtttgagtctgtcccttatgaagtgggtccagacgatgatgaaacgattcctcacgatgtaatgaaaatcagccgacggcaatctgttcctttgcatgttgcctggcgtttgcatcgtcacctgtcacaggaagaggtggcgaataaactgggcatcacgcaggctggcgtgtcgaagttagagtcgagaaaaaaacctcaaaaacaaacgcttgagaagctggctgctttatatgactgcagaacgtcacaactttatattgattaaatggatgcgcttttaacctgcgattggtgggttttaattgtcttttggatgagtgacataggatgggaggcgaggtctttgcagggaaaacagtgctccgttcagtcggataccagcagtgactgcgtaaagtcgtcgaaaacccatccctggggcctcggccgccggttcactcacctcatccatgaggctcgcccgcaagcgggccaacgctttgcattgttcaaaaacgctcccgacgtttttgaacaatgcggcggacgcttaactccgtcaatgctggtatccgccttctcatccacctcgggtacagattgtcagaaggacaaaaaccaggaaaggacatcttactccagcaggcctttttcaacgtttatgtccgactcaagcctcttttcaagcagccataaaaaagcctgagggatgaaaaggttcacctgaagagtaaagcgtcccacggcagggatggcgtgggcttagcgtcagtgtgcctgaggccgcgttccatcattcaaacagcaataaaaaagcttgaaggaagaaaaggttcacctgaagagtaaagcgtcccacgccagggacggcgtgggccgagcgtcatggatgacgaatgcgtctttacgatcaggtgaaccttttctgaccggcaccggtctcccagcgattgcactcacatgcaccgaacccaggtcgtaatgcttatactcatcactcaaccaatctgatcccccgcaacatgactcaccccacatccatcgaaaaaagatctcacccaatgaattaatcattcgttatgatggttagtaatttgaataatttattcctttgcggagcccgccatgaaacttgacctcagccaaatgatcaccgaaggccgcaacccggccagccagaatattgacgaactctccaccgaagcgatgcttcgcgtcatcaatgatgaagataaaaaggtggcgctggcggtagaggccatcgtgccgcagattgccgccgccgttgacgccatctgcgccgccttccaggccggtggacgactgatctattgcggcgcaggcacctccggtcggttgggcatactggatgccagcgaatgcccacctacctttggcacaccccgcgagcaggttatcggcctgattgcaggaggccataccgccatactccaggcggtagaaaacgcggaagacaaccgggagcagggcgcgcaggatctgaaagatatccacttcagccgccacgatgtgctggttggcatcgccgccagcggtcgcacaccctacgtactgggcgcgctggcatacgcgaacgaacttggcgcaaccactgtatcgctcacctgtaatccaggcagcgccatgtcgcaggttgccgcgattgcgctcacgccggtggtcggccccgaagtggtcaccgggtcttcccgtatgaaagcgggcacggcacaaaaactggtgctcaacatgctcactaccgggtcgatgatccgcagcggaaaagtgtacggcaacctgatggtcgatgtggaagccaccaatcagaaactggtacagcgtcaggttaacatcgtcatgcaggccactgactgtgatgaggcgacggccagcgccgcgctcaccgcctgtggcggacactgcaaaaccgccattctgatggtgctggctgacctggctgccgatgaggcgaaagcgctgctcagtcagcatcagggctttatccgtcaggctttacaggcagcgggagcacgctaatggccagaatcaccgaggcactgttgcgcgacatcctgcaggcggtcggtggcgcgcaaaatatcgcggcctgtggtcactgcatgacgcggctccgcctgacgctcaatcagccgggagagagtgatctggcacggttaaaaagcctgccgggtgtcttaggcgttatcgacagcgaggcacagttgcagattgtgctggggcctggcaaggcgcaaaccgccgccgaggggatgcagaaacctgctggctcagggtgataccgcgctggcaccgcagggcgaaacagcggaacttcgcgtgctggcgaagcggcagaagcagcagctaaaggcgaaacagaccagcggcgtgcatcagttcctgtcgcgcttcgccaccatcttcactccgctgattccgggctttatcggcgcggggctgctgctgggatttgccacgctgattgaacagagtctccacctcaacgcacccggtgaccacgcgccctggctgctgcataccgtggcgtacatgaaagtcttcggtaaagggctgttcacttttctcagcatcctgattggctacaacgcgcaaaaagcgtttggcggcagcggcgtcaatggcgcaatcatcgcctcgctgtttgtgctcggctatgtgcccacggccaccaccggctactacagcggcatggaaaacttctttggcctgacaatcgacccgcgcggcaacattattggcgtgctgatggcggcgattatcggggcgtggattgaaaaacagctgcgcaaaatcattcccgacaatctcgatatgatcctcacctcgctgtttacgctggtgatcaccggcgccatcacctatctgttgatcatgccgctgggcggcgaactgtttaaagggatgtcgtggctgtttatacatctcaataacaatccctttggctgtgcgctgctggccgggctgttcctgatcgcggtgatgttcggcatccatcagggctttattccggtctactttgcgctgatggaaacccagggttttaactcgctcttcccgattctggcgatggcgggagcaggccaggtcggcgcatcactggcgttgtggtgcaaagcagaaaaaggggcgctgctgcgggcgcagatcaaaggcgctatcgtgccggggctgcttggcgtcggtgaaccgctgatctacggcgtcactttgccgcgcctcaagccctttatcaccgcctgcggcggtggtgcgctgggcgggttctttatcgggctggtggcgtggctgggtttgccggtcgggatgaacacggtattcggaccctccggcctggtcacgctgccactgatgacctccagccaggggatcttcgctggcatggcggtctatctggccgggctgatggtggcctggatcggcggattcctgctcacctggtggtttggcacccgtaatgtcgacctcagctgacccgctgccggaattctccagtccggctaacggatggataatcaaccaaaaatgtgaaagccgctacaaagcggctttattattgccactaatttaacttaaacgctaaagagtaggcagaagcatgccgaaaacataaaaaaaggtaatcgttatctctcagcccacagttttcatgccgacactcagaccgtcgcgtgcaggacgtcgggtctccaaggacttttgatgcgtaacaaccagcctgtctctcagcgtgaatatctgttcgacgataatgcgacactgatgtcgaccaccgatcttaacagccacatcacctacgctaacgacgcgtttatcgaggcgagcggattcaccgccgacgagatcaacggccagccgcataacatggtacgtcaccccgatatgccatcagaagcgtttgccgacatgtgggcgacgctgaaacagggtgaaccctggacggcactggtcaagaaaccgccgtaaaaatggcgatcactactgggtgcgggccaacgccattccggtagtacgcgacggtaaagtgcagggctacatgtcggtgcgcaccaaacccacggcagaggaagtgcgtcagactgaggtgctctatcaggattttcgtgaaggccgcgccagagggcgacgttttcacaaaggcctgctggttcgcagcggctggcgtcgtcccgcctcaatcctgaagacgctgccccttcgctggcggatccgcacaacgttgctgacgttactgcccctctcggtggcaggcgtctgggcgctgggcatgacgcccgcggcactggcaggctttaccgcgggaatggctgcgctgcttctgctctgcagcctgtggctggagcagcagatttcacgccctattgagcggatgtgcaaacaggcgctgagcgtggcaaccggtgccagccataaagtggagcagatggaccgcgttgatgaggtgggtgtgacgctgcgcgccatcggtcagctcggattgatgttccgctggctggtggatgatgtcagcggccaggcgatcaacgtgctgagcgccagcgacgccatcgcccgcagcaacaacgaactcagccgccgtaccgaacaggcggctgccaacgtgcagcagactgcggccaccatgaacgaaatgactgccacggtgaagagcaacactgaaactgcgcatgaggcgaataccctctcagccggcaccagccacgctgccagcaaaggcggcgaggtgatgaccgaaatgatgggcatgatgggcgaaattgcggacagttcaaagcggattgccaatattaccagcgttatcgacgggattgccttccagaccaatatcctggcactgaacgccgctgtggaagcggctcgggccggtgagcagggcaaaggctttgcggtggtcgccggagaagtgcgcagcctggcgcagcgcagcgccaaagccgcgagcgaaatcaaaatgctggttgaaaccagcgccagccgggtcaactcgggcaatgagcacgccagcgcggcaggccgcacgatgcaggatatcgtgtcgcaggtgcagaatgtcaccgcactgatcgcccagatcagcgccgccacggccgaacaggcgaccgcgctcagcgaagtcagttcagcggtggaagatcttgatgatatcacccaccagaatgccgcccgcgtgacagaaagcgccgaggcttcaggtcgcatgactcatcaggctaaccgtctggtcgaagcgatcagcgtctttcgttaagagaagagattcagcggcccggttaagaggccagcgcctgcgtgccgtcgcgtccggcacgcagtgcgcctggtgactgaccgacaatccgtttaaaggcgcgactgaatgccgcaatcgagccgtagccgagatgataagccacggcttccaccgcttcaccgttgttcacaatccgctgcaccgccagccgcatccgcaactccgtcagatagcgcagcggcgtcatgccggtggcattgagaaaccgtccggcaaacactgagcgcgaacagcctgccacgctggccagccgcgccaccgtccagttttcgcctggctcccgatgcatcgcagcaatcgcctgactcagacgtggatcgcgcatcgcctgcaccagcccactgcgctcgccgcagccgttttctacccagccgcgcacaatcagcgcggcaaccacgtctgccagacgcgacagaatcccggcgaatcccgcctggcgggtgagcgactcccgctccatcgccgccagaatcggctgaatctccgggtattgcgacagcagagtactcaccagcatcacatcgggcatggtattgatcagcggctgcatgccgccgagctcaaacgccatgcaggcgctgaacaacagcacactgtgctcgtcatcacaggcatcttccggtgctgcaatggcgcagacgctgtcgcagagcggcttgctcgccatgttcttaatacactggcagctcgcctcctcactggagatcaggctgtgaggtttgccgtgcggcaccagcagcgcatcgccgctgttgagctgaaacacctcgccggaggcactgcgcaccatcagtgagccgcgtccgacaaagtggaactgcgcccggcccggcgcgtgatcataacgcagcccaaacggcgcgctcactgcgatacgctgatagttcacgccatagaggcgcatccccatcagcagttcactggtcagatctccatagtggctcatgtgattccagacgaattatcaaaaatgaaggtgtaagcatcatagatcgtcctgacacggcgttctatgctcacactcacttttttatcttccggagaagcagcatgagtctgacaaccgaagtggctgatgaggtttcctcgccgacccgtcccgcgtggggcgcggtatttgctatggcatttggggtgttcagcctcatcaccgccgaatttttacccgtgagtctgctgacgccgatggcccacagcctcggcgtatccgaaggccaggcgggacagaccgtcaccatcaccgcgctggtggcgctgtttaccagtctggtcaccggcagcgtcacgcggcgcatcgaccgccgcatcgtcatgctggtgttttcgttgttgctgatcgcgtcggcactgatggtggcgtttgcggctgacctgacggtgatcctgctggcgcgggtgctactgggtatggccattggcggcttctggacactctcaaccgccatcaccatgcgcctggttcccaccgatcaggtgccgcgtgcgctctctatcgtcttcagcggtatctcgctggcgacgattatcgctacgccactgggcagctatctcggcggactggtgggctggcgcaacatctttatgctgactgccggactgggtgcggtggcgctgctgtggcagtttctttaccctgcccgccatgccggcagagaacaaagcccgcaacggcggggtgctggcgctgctgcgtattggtgtgatgcgctggggaatgctggcggtaatcatgatgtttaccggtcacttcgccttctttacctatctgcgtccatttctggaaagcgttgcgcagctcaacctcaatcagctgtcgctggtgctgctggcctttggtgtggcgaacttctttggcacctcgctggccggtttcctggtcacccgcagcgtatcactgaccctgagtggcatggcgctgttgatgagtgtcaccgcgctgctgctggtgagctttggcgatgtcagctggatggtaggtgcaggcgtggcgatctggggtatggcgtttggttcgatgccaaccggctggtcaacctggatttcgcgcgcggtgccggatgatgcggagtcgggcggcggtttactggttgccaccatccagctggcgattactgtcggtgcagctgcgggtggctggatgtttgacctgcgcggcgcaggcggtgtgttcgttgccagcggagtgctgatgctgctggccgcgctgaccatcttcacccgggtacgacatcacggttaaatcctcaagggcagcaatatatgctgcctttttttatgggcgtagattattaaccttttgagtgataactgtgcgaaatgtgctttttatcatcaattttactgaacgagttaagcaaaaccctccgctttttactgatcaacttccggactaatatatctatcaacaaggcagcacgccttacctgataaaaattaaccgaggaattgaccatgaaatctatcaaaacttttgcagctgttatcgcgctttctgttctgccatttgccagcttcgcacaatctgtgaccgccatcgactctacgctggatggtgctgaagcgaaaatcgctgcgcaggctcaggaagctggtgcttcatataaaatcactgaagcttacactaacaacggcgttcacatgaccgctgagctgctgaaataagttaagttttaccctcttgtgctgacaggacgcctttgggcgtcctggcggcgtttatccgctaataatcctgtccctttccccccgaaataattattattctcaaaaacaattctgcatctgactgctgtcagctgtttctggttgcaatgtcgggctttcttttcactgcgtctgcagtggattaactatggagaagttatgaaagcgattaccaatacgtgccggaccctgcgtccgctgttactggctacagccctgttctctgcctcaggatggctggcggtgcaggctgaagatctcaatcaggccgtgggtaaaggcgtctatgaactggcagtcagtccgaaagataacgcgctgttcgtggcgacagcgcagaaacagcagcggtgacggcggcacagttttccgtctcgacccggctacgctggcggtacagcagtcgatcaacacggagctgaaatcgttcggcgcggcgatcaactcgcaaaccaacgtgctctacatcggcaacaccgtaaacggctcggttacggccattgacgccagcagcggcaaagtgctcaacacgctggtgctggatagccgtaagcgcagtgagacagtgcgcccattgcagccgcgtcaggtggcggttgatgctaaaactaaccgggtttatatcaccggcctgggaccgcaaagcgtggtctgggtggtggatggcagcacgctgaagcttgtcagtaccatcccgaataccggtaaaatgggcaccggcctggcggtagattcagacgcgcaaaaggtctacgtcaccaacggtgatggtgaactggtgacgatcaatgcgcgcaccaatgccattgagaaaaagcagaagattgacggagataaagagcacttcttcctgaacatcgcgctggatacgcgcggtcagcgcgccttcctgacagattcaaagcaggcgcaggtgctggtggttgatctgcgtaatcagcaggtgattcagcggattgatgtcccggaatcgctggcggtgctgtttaatggtgatcgcgatgagctttatgtcacccatcgcaaagcgggtgaagtcagcatcatcgacgccagcagctataaggtgaagcgcacggtgaaaaccccggcgctgcctaacagtctggcactctcggcagacggcaaggtgctttatgtcagcgtgaagcagcctggctcgcgtaaggcgccgccaaaaaatcctgacagcgtgatgcgtattgcactgtaaggcgtgacgtccctgacactgctgtgttgaagctgttttacatccggtctttgtaaacgagaaagccactctgacgagtggcttttttatttaaacagaatcgctttcgccgttttgagggttcagatgcgaaaggccactctttttccggtcggaagttccacatcaagactgagttttccgcccattgcttcgacatagcgtttcagcgtggcaaccttaatctcatttccgcgttgctcaatctgagcaacggcaggctgacgcacgcccatggcctcggcgagcgtcttttgtgataactgaagctcttcgcgaatcatctgaagcccgacttccagaatcatttcatcagacatttttttgattcgcgcctgactctcaggggagaagtcggcgataacatcatccagggttctcattaattatttcccttctcctgttcagccagccaggctgaaaattcatcgtcagcgatgcgtatcattcggatataaaaacgtttgtcatgactcttatctccggcacataacacaatagcctggcggacagggtcaaatgcataaaatgcccgaattggctttcctgaaaactgtacgcggagtttctttcatattcctgtactgcgagcccttgagagtatcagcataagggcgaggcaaatcagggccgtatacttttaactttcccagatccgctaacattttttcctgcagggcttcttcctgctcacttagccagctttcaaagcgcgggctcaggagtacggtccacatgacatacttccttgtatatattccgtcatacagggtacagattataagctacagcttataaattcaagccagagaacacgcatgacggctgatttaagcattaaaaaagcccgctttcgcgggccaggagcagcacatctctgctgttacaggagtcctgcaggttctttgcgggatgatccgtggctgaggagagtggggtggaaatcgacctgtgccgccatacttaagtagttacacctcttccgacgcttcgcgcatcatctcatcgtgcggaacatcatccagaatctgctcaaagctgcgcagacgcttatagatcgacattagttcaatcagcgtcgaccaggaggcgatcagatactggaacgagccgcgcacctgatcaaacacgttggtgatctggttgagtaagcccagcgtgatggtgcccgccacaatggatggaaaaagcagaaacagaccaaacacgttatcaacctgcagatagagaatgcgggtgatgttgaagtagagatagtgaaagtagagacggaagtagttaacccgcacccgactgaacaactcctgaaccgtctgcggtgtggcacgatcggcattgtcttcgccgtagaccagttctttacggtaggcggcttcaacccgctgattgcggaactccagccccggcagcttaatccctaccagcgccagcaaaccggtaccaaacactgaccagagcacagcggcaatcaccagtgcgtaaggaatattgccgaggatgggaatatctttcacgtgatgggagagcgcgaccagcaccggtaaaaaagccaccagcgtcataattgcctgaataaaactgacaccccagttttccagcgtggtcgcaaaccgcatggtgtcttcctgcacgcgctgtgcggcaccttcgacatgacgcagacgctgccagttgtgcatgtagtagttattcatggcgctacgccagcggaaaacccagtggctgataaagaaggagttgagtacgccaatcaccaccgcgattaatgcgatgccgagaaaagagaaaacctcatggtaaaactccgcaatctgcaccgatcccgctttggttaacgctttctgaatcagatcataaaacggtccataccaggcgttaatggccactccgacctgcacgccaaaccaggtcacaaagatgatcagcgcggagccccagactgaccagcgttgccatggatgcgcatcaatcaaccgccagaccccggcaaaaatggctaccatgatccagtaatagaggtagaaccagagctgactcacggcgataaaacgcgctgccgtcgtcggcaggggctgtttcattgctgtttcaaaggtgggccagatgccgggcagatgcgcggcaaagccgaaccaggcaaaaatcgctactaagctccagacagccgcagagctgaaaaacagcgctggccgcggaaaaaaagacttaaacataggcactccgctgttgtgtgttgcctgttataacgtttttgacgggtcgctgtctgtagtctgttgtttctgctaatgacaggagggggatagatgttaatgaaattgtgcggttttgtttcctggaactaaatctttgtgaatggcagtgttacaataggttgtttgttaccggtaacaaacaggctcctggcctgtatctgctgataaaaaccattacaacgcaaccacctatttttttcataccgccggtcagcgcgggaatgaggcaatgtcatgtcagaacaaaaaaagggtcattcacgcagggattttttgctgaagacaatcaccctggcgcctgcaatggcggtaggttccacagcgatgggtgcactctccctgccgctggccacacaggcggctgaaaccccggccacgccacagcaggcgcgcgactaccagccgaaactggttcaccgccgaagagtttgcttttattaccgccgccgtggcacggcttatccccagtgatgaacgcgggcctggtgcgctggaagcgggcgtgcctgagtttatcgatcgtcagatgaatacgccgtatgccacggggtcgaactggtatatgcaggggccgtttaaccccgacctgccgaaagagctgggctatcagctgccgctggtgccacagcagatctaccgcctcggtctggccgatgccgataattacagcaaaaagcagcacggcaaggtgttcgcccagctcagtggcgagcagcaggatgccttactgcaggcgatggaaaatggcagtgctgaattcagccagctgccagcaaaagtcttctttagcttcctgttacagaatacccgcgaaggcttcttcagcgatcctatacacggcgggaatcagggcatggtcggctggaagctgattaacttccctggcgcacgcgccgactttatggactgggtagagcgcggcgaacgttatccgttcccgtcagtgtcgattcgcggggagagaagctaagcatggcaaacgaaatgaaaaaagtggatgcggtgattgtcggcttcggctgggcgggtgccattatggcgaaagagctgaccgaagcgggcctgaacgtgctggcgctggagcgcggaccgcatcgtgatacctatcctgatggctcctatccgcagtccattgatgagctgacctataacgtccgcaaaaagcttttccaggatctctccaaaagcaccgtgaccattcgtcatgatgcgtcgcagaccgcagtgccctatcgtcagctggcggcatttctgcccggaaccggtaccggtggcgcgggtcttcactggtccggcgtccatttccgtgtcgatccggttgagttgcggatgcgcagccattacgaagagcgctacggcaagaacttcattccggaaggcatgacgattcaggattttggcgtcagctacgatgagctggagccgttcttcgacaaagcggaaaaagtttttggcacctcaggcagcgcctggagtatcaaaggcaaagtggtcggcaaagatacaggcggcaacccgtttgcacccgatcgctcagataacttcccgctgcccgcgcagaagcgcacttactcggcgcagctgtttgctcaggcggcagagtcggtcggctatcacccttacgatctgccgtctgccaatacctcgggtccgtataccaacacctacggcgcacagatggggccgtgcaacttctgcggttactgcagcggctacgcctgctacatgtattccaaggcgtcgcctaacgtcaatatcctgcctgcgctgcgtcaggagccgaagtttgagctgcgcaataactcttatgtgctgcgggtgaatctcagcgatgacaaaacgcgtgcgaccggcgtgacctatgtggatgggcagggccgcgagcagattcagcccgctgacctggtgatcctctccgccttccagttccacaatgttcacctgatgctgctgtcgggcatcggcaaaccctacaacccgattaccaccgaagggaccgtaggccgcaacttcgcctatcagaacctctctacgctgaaggcgctgtttgataagaacaccaccactaatccgtttatcggtgcgggtggcgcaggcgttgcggttgatgatttcaacgcggataacttcgaccatgggccgctgggctttgttggtggttcgccattctgggttaaccaggcgggcaccaaaccgatctccggcctgccggtgccggcgggtacgcccaactggggcagcaaatggaaagcggcggtggcggatacctacacccatcatctgtcgatggatgcgcacggcgcccaccagtcttatcgcgccaactaccttgatctcgatcccaactacaaagatgcttatggacagccgctgctgcgcatgacctttgactggcaggataacgacatcaaaatggcgcagttcatggtcggtaagatgcgcaatatcgcggaagcgatgaatccgaagatgatcatcggcggcgcgaaaaagccgggcacccatttcgactccacggtttatcagactacccacatcagtggcggggcgatcatgggcgacgatccaaaaaccagtgcggttaaccgttatctgcaaagctgggacgtaccgaatgtgtttgtaccgggcgcatcggctttcccgcagggactgggctacaacccgaccggcatggtggcggcgctgacctactggtcagctaaagcgattcgcgaacactacctgaaaaacccaggcccactggtgcaggcataaggacatggcgatgaaaaatggcattctggctctgattcttggctccctgacgttcgccgccctggcggagagcagccaggacgatctggttaaacggggtgagtatctggcgcgagccggtgactgtgtggcctgccacaccagcaaaggcggcgcggcctttgccggtgggctgccgatggcaacaccgattggcaccatctactccaccaacattacgcccgatcccgcgactggcattggcgaatacagctacgacgacttccagaaagcggtgcgtcagggcgtggcgaaaaatggcgatacgctctatccggcgatgccatatccctcttacgccgtggtcagcgatgaagacatgaaggcgctttacgcctacttcatgcatggcgtcacgccggtcgggcagccaaaccgggagagcgacattccctggccgctgtcgatgcgctggccgctggcgatctggcgcgggatttttgcgcccgacgtgaaagcgttccagcctgcagcccaggaagatccggtgctggcacgtggtcgttatctggttgaaggactgggtcactgcggggcctgtcacacgccgcgcagcatcacgatgcaggagaaggcgctgaccaacaatgagggcagcgactatctggcgggcagcagcgcaccgattgatggctggaccgccagcaatctgcgtggtgacaaccgcgatggactgggtcgctggagcgaagaggacctgcgtcagttcctgcgttatggccgcaacgatcagaccgccgcttttggtggcatgaccgacgtggtggaacacagcctgcagcacctgagcgagtccgatatcacggcgattgcgcgctatctgaagtcgctgggcgcgaaagatccccatcaggcagccttcagcgtcgatgacgccaccgccaaagcgttgtggaaaggtgacgacagtgcgacgggtgcagccacctacgtcgacagctgtgcggcgtgccataaaaccgatggcagcggctataaacgtttctatccggcgctgcgcggtaatccggtggtgctggcggacgatccgacctcactgattcatatcgtgctggtgggcggacagttgcctggcgttaatggcgcgccgtcgacgattaccatgccagcatttggctggcgtcttgacgatcagcaggtggcggacgtggtgaacttcgtgcgtaacagctggggcaacaaggcgtcggagccggtcagcgcgaaacaggtcgctgagctgcgtaaagatgagaaagatcggctgggcagtgcagatatccgggtactggaaggcaaataatcagcagtaaaaaaggccgtcatcatcaggatgacggccttttcttttagatattctccagatcgataccgcgcgttttcggcccataaatccctaccgacagcatcaccatcaccatgctcagcacgataaaggtaatcacgcctggcgtaccggcgtactgcaggatcaccccaatcaaaatactgctgaataccgtagagaggcgactgaaggagtagcagaagccgaccgctcgcgcccgaatatgggtcgggaaaatctcggtctgataggcgtggaagctgaaggtcagccaggcgttggaccaggtgatcaggaagccgcagagaatcagcaacaccggctgcgtctggaaggcgaacaacgtgccgaacaccaccgtcatcagcgacgacaggacaatctgccacttattctccagcttatcggcgtagcggctacagatcagcgatcccagcggataggccagcgtgatgaagaaggcataaagcaaactgtgcgtcaccgtggcaccgcggcctgacagcagcgcaggcagccagttaccaaagccgaaaaagccgatcgcctggaaaaaattcatcaccaccagcatcagggtgcgcttgcggtaagcgggtgaccagatctcgctgaagcgcccccgttttggcagctgcgccgcggcgtcgtcggctgaaaaagcgggtcctgccgggatgccgcagcgttgctccatcgtggacagcacctgatgcgcctcgtgatgacgaccctgctgcgccagccagcgcgccgactccggcaggtttcctgcgcaccagccagatcaccagcgaacagaccgcgcccgcaatgaccacccagcgccagccttcaaggctgaacagcgtttgcggaatcagccaccacgacatcagcgccacggccggcactgataaaaactgcacgaaaaaggagaaggcaaaggcgcggctgcgcagatgggtcggcacccattccgacagataggtgtcgatggtcaccagctcgacgcccagcccgatccctaccagaaagcggaacagaataatcatctccgcgctctgctggaacgccatcagcagcgaaaacagcccgtaccacagcagcgcacacataaaggtgagacggcgaccaaagcggtcagcgtagggtgccagcaggctggcaccgaaaaacagaccgagaaaagtggccgaggcgaaggccgcctgatcggagaagcccagcacgcctgccgcacccgtgtgaaatacgcccgccgacagcaggccggtactgatgtagccggtttcaaacaggtcataaagctcaaaaaagccgcccagcgccagcaacgtaataaagcgccacaatccggcggatgagggcagcgcatcaacacgagcggctaagctgttacgggccgccgatgaagcgtgcatcggtggcaggctggtggaggaggtggtcatgtcagcgtgaacctcaggcagtgtagagacgactcgcagccggtcggaggcttattaaaatagttaaccgttagcaagcgaagaaatagcagaatagtcaattcatccgccgttgccgagagggtcgttgctgactatttagcaacgtacgttgcaggttttgccatccgtggcaggcgcactccggcagcggcgaccaggccagaatctgattgcagcgaactccggactgtctctcagcccggtaacgcgggggcaggagcgcatggatgcaaatggcgtccttgcgttatcatagccttgctttatgacaccttttcacggacgcggaaaaagctgagctgaagaagctgacacaattactgaaagatgaggtgtaacgtgagtttttttgacgagctgaaagcatcgctggaagaggctgtggagatcaaaaacggtatcagggagcccggtcgtgttacccgttacgcggttgccgacgtgaaggctatccgggcacagcttaacgtctcacagagtgagatggcgacggcattgggaaccagcctcgataccataaagagctgggaagccggacggcgtaatccgaccgggctggcagctaaagtactggtaactatccagaaaaacccggaattttttaaggagctggcggcgcaatgagccgttgttccctgcacgccgtttaacaaaaaataaaacgtgccaccgatgaaacattcatcggtggcactgtgctttaaggcagtttcggccagacgcctggcccgatcggcagacccagcagataccacaccagcagcagcgctatccagctgataaagaacaccagcggataggggaagatcagcacgtaataggtgccgagctgcgcatctttctggtaacgctgcaaaaaggcgagaaacagcggcagaaacggcgacatcggtgccagtggcagcacggcggagtcggcgatgcggaaaatcatctgggcaaaggcgggatggaagccgagcagcataaacatcggcacaaagaccggcgccagaatcgaccagatggctgagccgctggcgataaacatgcagagaaacgccgacaggaacatcaggccaagaaaagcgggcgcgccgctgacgcctgcgctctccagcacatcagtcagcccgatcgccatgaatttgcccatgttgctccagttgaagaacgccacgaactgcgacagcggaaataccatcacgataaaacccgccatgcccttcatcggatcgaccagcaactgcgggatatcatccggacggcggatctgtcgggtgaccacgccataagcaatcgccaccacaaagaagaacagaatgatgatcggcacaatgccctgaataaaaggcgagggaataatggcgccggtggcgggattgcgcagcggtgcattttccggcaccaccagcagcgccatcagggcgataaacagcagcgcggcgatcccggcagcccgcagaccgcggttttcaagcggcgtcagcgccgccagcttctcgccgttgccctgccactttggcagtcgcggctcgacaaatttatcggtcagcagcgcgcccacaatcgtcagcacaatcaccgacgtggccataaagaaccagttatcgatgacgctgacatgcaccgtgtcgctgaccgctttagccgcttcagtgctgatgcccgagagcagcacatcggtggtgacaatcagcaggttggcggtaaagccggaggccacaccggcaatggcggccagcaggcccgccaccggatgacggcccaccgccagaaagatcagtgcgcccagcggcggcatcactaccagcgcggcatccgaggagatatggctgaaaaaggcgataaacagcaccatgtagctggcataacggcggctgacgcgtgacgccatcttcaccatcagcgactgcagcaggccgaccttttccgccagtccggcaccaatcaccagcgccagaatcgatcccagcggggtaaagctgctgaagtttttgatgatatttggcaggatccactgaatgcctgcgacgctcagcaggttattcacccgcacgatttcgccgttgctcgggttcttcaccgccagatccagcgcgctgataatggcggtcgccaccatcagcaccacgatcagatagacaaacagtaaaaacgggttggggactttattccccacgcgctcgatccagctgaagagccggccaggactgcggtttctcggatgttgcttccatggtattggttctcgtcttgtgtcccttttatcggcggtagcaaggcctgacgccggtcgcgttgtgcgacaggcggtgagttcagttccggcaccgctgaatcggggaagtgtttgcaatattttttatagtggtccgtgtcagagacacggccgttggctcattcggccagttttgttggtgtgatccccgccgggatcgggcagtgatagggctgcgcggcgcgtacccgatcaaactcggcccggcagccagccagcgcctgccgatccgttaacagcgttaacaccgtggccgccatcactttgcccgccagaaacatccccttatgcccgatactggtgcgtccctgcgccaccagttgccaggtgtgcagcggcgtgccgaaggtaaagcagggcgcaaaacactgtgcagtcggcgtcacccagctgacatcgccgacgtcggtggagccataaagcagttcacgtgtgaccgcatagggcgcgacctcatccataaacagcttgtcgcccagtttttcagcccaggcgtgaccggcttcaccaccggttcgggcggcattgagccgggcattgcgcagatcgtcatcagtgagcgtggcacgcagttcagccgcaaacgcgcgttcttcgtcgctgtagtcgggcaaaccaaactgatgcaaataacgctccatgaccgcttccagcgcgcgattcgggacgtaatccgagcaggctttgtcaaaacgtacggtcagcgtggtgtcggtcatcagcgctgcccccctggcgatattgatcacccgttcataaatcgcctgcgcctgtggcagttccggggcgcggatcaggtagagcacctccgcatcggcctgcaccacgtttggcgaaacaccgccgctgttggtgatggcgtagtgcagacgcgcctcctggacgatatgctcgcgcagaaagttggccccggtattcatcagcgtgacggcatccagggcgcttcggcccagatggggagaattggccgcgtgcgccgcaacccctttgaagctgaacgccgcctgaatattggcgagggtgcgcagattgaacatgccgctgaacccctccggatgccaggtcacggcggcatcaacgtcgtcaaacagcccttcgcgtaccataaaagtcttgcctgaaccgccttcttcgccagggcagccgtaaaagcgaactgtgccgcccgtgtgatgctgttccatccaggctttcacggcgcaggccgccgcaacacctgccgtgccgagcaggttgtgaccgcagccgtgtccgttgccgttggcttccagcggttgtggccgggcgcagcccgcctgttgactcaggcccgccagcgcatcgaactcgccaaggatggcaatcaccggcttgccgctgcccgcactagcgataaacgccgtatcgatgccacccacgccgcgttccactctgaatccctcttctgccagcgcatcagaaagcagggctgacgagcgggtttcggcaaagcgggtctccggtgtgtcccagatggcgtcactgagcgtgctgaaacgaagctgatgacgagcgatatagtcggcaataaagtcttccatcatcgtgagcccccatactgcgcctggttcagcgccagcgtcgccagcagcgtgatggcgtccggcatcacccgctcatcaaagtcgaatttcgcattgtggtgacccgccgccagctcacagccaaaaatgacgtaagaggcctgaccgccgcgctgctttacccgttccatcatgtaggtcgcatcttccgaacccgccgcctgcgctttacgatcgaccacggagtcgaagataccgagcgagtccgcctgctgatggatgaaatcaacccatggctgcgtcggggtacagctgcgcgcggcccccatcagcgagacccgctgctcaacgccatacatcgccgccgcaccggcaatcacccgcagcgcctgctgatagatgtcgtcgttgacctgattggtcacgccacgggtttcgactttcagcagggcgcagtcggctaccacgttgcggccggtttcccgcctgcagcacacccacgttgacccgtgccacgccgccgctgtgctgggttaaaccatgcagcgccagcgttgcctgtgcggcggccagcagggcattgcgcccctcttcaggacgaccgcccgcatgggcaccgacgccggtaaagtgaacatccagcttggtagtggcgaggaagctgtcgctgccgcacactacttcgcctgccggcacgccggtgccgatatgaatggcggtgaagcgatcaacgtcatcgaccacgcccgccgccaccatcgcttttgcgccgcgcacaccctcttcggcgggctggaagatcagtttaatcgtgccgctgagctgatctttcatcgccatcagcaccgaggcgagacccagcccgatggtggtgtggccgtcatgcccgcaggcgtgcatcatgcctgcgttgcaggaggcgaacccttctcgctgcggcagatgatcgtcagcctgactctcgttgagatccagggcatccatatcgacgcggaagcccatcaccgggccaggacggccggtctcgagcgttgccacgatgccgcagaatccgccggagaagtggctgatccactgcggcagcgcgccctgttgcagcgcgcgcgcttcctgctgcttcagcaccgcctcgtcgggcaagcccatccgcgcgtcagcgtcgatgacctcacggcccagcttcagttgataaccgagcttatgcagctcttcagcgactaaggtggcggtgcggaactccagccagcccgattcggcatagtgatggaagtcgcgacgccactgttgcagctgtggcagccgggcgctgacgtggtctgaaagggggttcatcggctctatcctcgttgttgattttttatgcactgttccgaatctacacaatggtattgaccggcataagatgcgaatatcttgtgactgataaacaacggttatcgcaaaattatgtctgccaatctcaagctccatcagctgcgcgccttcgttgacgtggcgcgacagggcagtatccgggcggcaagccgtctttccgggctgtcacaaccggcgttaaccaaagcgattcaggaactggagcgcgagctgggggcaaagctgtttatccgccgtcagcagggcgtggtgttaaccgatatcggtgataacttttttcggcatgccagcctggtgctggcagagctgcgggtcgccgaggaggatattcagcagcggctgggactgggtggcggtcaggtgaatatcggcgtcggtggcagcgtggcgcgcaccattatgccgcaggtgattaaccagtttcatcgcgaatacccgctggtgaaggtgcgcatcgtcgaaggccagctggtgtcgatggtgcatgaactgcgccagggcgcgctcgatttcaccattaatacctacgatcagagccatctcgatcaggagctgatgtatgagcggatgatggagcgcgagtacaaggtggtggtgcgcaaaggccatccgctggaaaaggcgcgttctctggcggagttacagcaggcggactggacgatgccaacgcctaaaggcagttactaccgcttgttgcacgatctgtttggcgagcgcggcatggccccgaaaattgtggtgacctgtgaaacctttatggcctgcaccagccttgtggcgcaaagcgatttcatcagtattctgtcggtcgacgtcattgacgacccgattctgggccggtcgctggtggcgctggcgctcgacgaacccctgccgaaagcgatcttctatctgatccagcgcaaagacaccacgctgaccccaatgagcagttatatggcacaactctttcgccgttattgccagtaaaatcagtgagtaaagtcgatcgtctacactgttaaggtactgaaaaaaatccacccgacaaatatagaggttacgatgcaagtcagtccttatctgtttctctatggccgttgcgaagaggctatcgacttttacctgcaggcgaccgggggagagttactctctaaaatgaaattcggtgatatgccggaccagggtgagcaggtcggcgatcagtctgccgcgccgcagccgccagaaaagatcatgcatgcccagctgcgtattggtgacggtgagctgatgctgagcgatggcaacaccgatcagccgccagcgtctgagcatgccggttacgcggtcagtctctcaactaacgatgtcgaaaagggtaaagcctggtttgagaaactgtcggcaggcggcaaggtgacaactgagtggcaggagacgtttctggtcgaacggattcgcgatgttcattgataagttcaacattccatggcgcatcaacgtcgagaagccgcaggaataatcgggccagccggcgtcgcaatttgcggcgccgtattaattaatggcaactgcccggattaaagcgcggcggcgctattcaggccgccgcacgtaatcagaagttataacccgccaccaggtagtaaccccagccagtcgatttcacttcaaacggcccgttgccgaaattcagctcctgaccatccgcccactgtccgccgttgtggaagtaacgcgccaccgcagagaagtgccagtgatcgtaacccagtgacagaatatggctggaggcgatggagttgctggtgcgtgatgaaccgcctttatcgcggagatcggaaccccagtcgaagttggtgaagcccacatagcccagattaccgccccacagtgtggtgattggcacgaagtatttcaccttgaagcgatagccatcccagctgttttcattcgccgcaccgtagttttcccactgatatttggcgtagacgttcagcgacagaccgacatcactgtgcgtatcgatatcggtgcccagacccatataccaggtgttctggcggctatcgctgttgcggcccatgtcgtagatgtagttgttagcgaaataccactctttgaacggaccaaacgccaggctggtgccggtcagtttgtcgatagagaagcgcggctcaatctccataaacatcggtgaaccgtgatcaaaaatgccgttggcgttgctgttgcctgcgccgaagaagttggtcagatcgaggtagccataaaaatcgaaccagtccttcttcgcaaacgcttcatattccagataaacgtcgttgttaaactgcggtccgaaacgggtgtggtagctgcctaccacgttaacgctctgatgccaccagtcggagacatactgcggatcgctttcagcggcctgcgcagcgccactcaatgaacatgccagcacggcacctgctatcaacgttttaaatttcattattatcagccacatgcttttgaccgccgcacagcagacgcagtcagagagaaatcggtcccttgatgggaatgagggtttcacagcaaataacagccagttcttcagcccgcgtagcgtgcctgtaacagatcgatagaaaatagattttgctcacgtttgtcaaaaagtgttgcattacaattcagctaaaatgtgatgcgcttcacaataatgaccaggatagaacggaaccaggcaaccgtttacgttgtctggttcgtgatcaaacgggcgggatcagggaagggtgacgcgaacctgcaaaccacaaatggcaccctgtggcgtcaggcaattggaaagggcgacgtgaatctgatgcttctgtgcgacgttgcgcacaatggataatcccagtccgctgccctgggctttaacgtcaggcgaacgggtaaaacggtcaaacgcgcgttcgataaaggattccggcatgcctggcccgttatcgacaatatcgaccactgttttacctgcgacccgatgcagcagcacatcgaccaggctgccctccggcgtgtgcaacatggcgttaccaatcagattgtcgaacaggctgcgcagctcggaacggctggcctgcaaacgatactgcgtggagccattaaagccgatatcgatgccgcgtttatctgccaccaccatcagctgctcaatgctctctttcagcagatcgtccagttcgatatgctcgacgctggcgaccacgctctggtcatcctgacgcgagacattgagtaactgcgtgaccagatgacgggtgcgtgtgacgcccgcttccagctggctgaactgtcggctcgcttcgcctggctggatgtgctgacgcagattttccagctgcaaggtcaccgccgttactggcgtgcgcagctcatgcgccgcatcttccaggaaactgacgctgcgacgaccaggcctcacgcagcttactcagcagcgagttgtaggcggccaccagcggcaggatctcatccggcaagccttcgggtgagacattgtgcggatggtgcgtctcctgcgcggcaatctgacgcgaagcgacctgaagatcccgggtgatcttgcgcaccaccagccagatcaccagcagtgacagcggcatcatcaggatcaacggaatgatcgctgacagcgcccgcttgaccatcaatgccttcatgtagctgaggttgtgcatcacctggatggttttgatctcgctgccaggtaagccgggccgggtatagatgcgccattcgcagtcgtcgcactgacccacatgcacgtcgcgatagccgcgttgattttgcagcggagcctgcagctccggccatgagctggctcgtaactgaccccgatcgtcccacagttgcaccacaaaggcgctcttcgccttgtcaggcgcaataagcatcggcatcagggcgggcatctgtttattagtggaccaggcatcagcgatttttgccagctgatcgtccttcatggtgccaaccatatcgccatagcagctgaagaaataccaggtgacgccaccgatcatcagcagatgaataatcagcagcgtagagagtaatttgtttcgtaatgaacgcataaaggtgaagggtttcatattgccggtacccgccagcccagcccgcgcacattgcggatcacgtcgttatccagcttgcggcgcatcccgtggatcaggacatccaccgcgttgctgctgacttcatcgccccagccatagatgcgattttccagctgctcgcgcgacagaatagcgcctggccgctccagcagggcgtagagcagggcatattcgcgcgccgtaagctgctcgcgctgtcctttgtagagcacttcgcgggtcatcatatccagctgcacatcgccgctgcccagcaccgagtctgctgcgccgtgactacgtcgggtaatcgcgcgcatccgggccataacttcctgtaaatcgaacggtttaagcaggtagtcgtcagcgccgctgtcgagtccctgaatccgctgcgccaccgtgtcgcgtgcggtaagaatcagcaccggcgtggcgtcgccgcgcccgcgcgcccggcgcagtacctgcaggccatcatcgcgcggtaagccgagatcgagcagcacgcagctgtagccgccttcgctccaggcattctgggcatagatgccatcacgcacccaatccaccgaccagcccgcgccctccagtgcctgctgcaggtttcgcgccgatcatttcatcatcttcaaccagtaacacgcgcatggctgatctccttcagaaagatgaggggagtttactcaccaattgttaggccagaattatccgccgtcatacttcgcactgtggcggcgttggctgcttttgctcaccccagtcactgacttatgtcagctcctggggactcgcgcagttgccgccttgccacagcacggattattttggcggactactgccgtcatacttcgcgctgtggcggcgttggctgcttttgctcaccccagtcactgacttatgtcagctcctggggactcacgcagttgccgccttgccacacatgaattatttcgcggaccgccgtcaccggtattttatggaggagtcaggtggcctgatgtccccatccatatccattgagatgccagcgattgcaagcgtaaatggggtgacgtatatttgagcaacagattaatgccagacatttcagcggtgaatagtatgtcagcccaggaagcaaaaatcagacatcagcgcgagtatcaggagcgtgttgaagccgtccgaaatggtcaggctccaggccgcgtgcttgaaaaacgtcctcagggtattgtgcctgcaaaaagtggacgcagcctcgcatttttctgatgtcacgccgtgcttaaatcagccaggtagtaaaataagctcatcatacaggtgggctttttttatgacattgcacgctattcctccagaagaacagatccttaaacttaaccgttatcttattgataacgccgaacaacttccgtcaccggttattactgtaggcggtcaggctgttatgtactggtatctgacctacctgcatctttatcctgatcagcctgatgtaacatccataacctcaattgatgttgattatgtcacccgaaaggaaggcgttgatgtgattgcgaaaatattcaatgtggcagcacaggttcaggaaatttttaatccgccctccattgcagtattaagtctgattgataaagatacgggcagggtcaaagaggatgctcagggacagtttctcaatgagcagctcaatgaggcaaatattgtagatattattgatcggcccacaggctttaatgtcggggattttctcaatgataaattgacactcaatacagaaccctttctggttatgcccgatcgacacggcgctgccatgagtcatgaatttgttcgggttctgaaccctgttgcctgtatccgctctcgcctgtcgaatgccactgtgcctatgggtaagaaacagactgactgaagctgagcgaattcgggtactggctctgccagcctttaactttttgctggagaagttacagacattacctttccggcagggaaggcgttacgttgattactttgtctcgtttatctgggatagagcattcagacgttttcaggcacaacatagaatccccttgtaccgtattgttgaacaattggtggctgagctggaactggagcccggtgacgatatgcccccagaattctattaggaggagttatctcggaaggttgattttctggctcaggaatatcagcgatatctcaaacatgttgacgcctgacagggctgaatgcccccgtcacttatgatgcagaaataaatttgtctgactcagcgtttttatcttctgccttttttcagcagcaatctcttcacgaactttcacactaaagccccgctggccgcgcgattccgcctccgtttccgccgttgctaattctgcgctaattttctgctaattaagggataaattttagcaggtagagtggctccactgcacatcagcatcaacaggaggaaccatgaatcagcgcgagtttattcggagtttgctggactggattgagaacaacttaggacacgatctgcatctggatgaggtggcgcgccgctcgggctattcgcgctggcatctgcaacggctgtttcgccagcataccggcttttcactggcagaatatatccgtcagcgccgtttaaccgagtctgcgctcacgttgctgagcagcaacgaagcgatactgcaggtggcgatgaactatggctttgatacccagcaggcctatacccgcacgtttaaaaactactttatggtgacgcctggccagttgcgccgtcagcgtcgcgtcgagccggatcggctgctattccctctggcgatggccagctgatgcctgataagaccttcccgtcacagcctgcggacgggaaggtcggcccgcgctttgcgcttctctccacttgttcttcgcctcgcctttttttgcacatcagccacagtgaccccgcccggacgtgttagtttgttgccagcattcctttactgtcggagtcgggaaacatggaaaacggcgcgaatttaaccgccatgttggtatttgcacgggttgtggaattacagagtttcagtgaggcggcacgcgcactcggcttgtccaaatcccatgtcagccgggagatcgcccgtctggagctgcggctcggtatccggctgctgcaacgtaccacccggcggctggcgctgaccgagctgggccaggcgtactatccctactgtgtgcggatgctggccgaagtgcagcgcgccgaagcctttgtgcagcaggtgcatcagcagcccgtcggccatgtcaggctgcaggcacccgttacgtttcggctgccagtgcgtagtccctgtccttaaccgctttctgcgtcggcatctgcatatcaatgtcgatcttgatctgaccgatcgcagtcacgatcggctggatgatcaggcggatctggcgattgtgatccgatcccgatcgccacagcagggcaattttcgggtactgagcgaaatcgagtgggggctctatgccgcgcctgcctacctggcgcagcgacccgctatcacacatcctgagatgctgccacggcacgacctgctgctgtttcatggtccggcgcagaccgccgcactgccgttccgccgtgataaacagcggctggcactggatgtacgcagccgttttcgcgccaataacagtatggcgctgctcaatgcggcactggcggggagcggcatcgcctatctgccctcctacatggcccaggaggcgatggcgcgcggtgatattcagcaactgctgccggagtggcagatggatcgtctgcaaagttatctgctgctgcacgacacgcctgaaccggcgtcgcccgtgacgctgctgtgcgatgccctggttgcggcgctgaatacaggctgattgttgcctactgacaacaatcagcgccacagagtaactatcccgccgcgactgttgttactccgctacgccggttagcctgtatccctgattactcaccggatatcatcatgcaacagtcacccgaaactgcagagtttcagcactggcgacgtaacttaggggtctgcgtcgtcggctcttttaccactatcgtggcgatgacgctgctgctgccgtttcctgccgctctatgttcagcaactcggcgttgagcagcctgccgctatcgcccgctggtccggccttgcctacggcgcgacctttttcagcgccgcactgacggcgccgttgtggggcaggctggctgaccgctatggtcgtaaggtgatgctgattcgggccagtctcgggatggcgattgcgatgtcgctgattggcatggcgaccgcgccgtggcaactggtggcgctgcgcctgctggcggggctgctgggcggctacgcatcgggatcgaccattctggtggcggcacaaacgccgaaagcgcagaccggctgggcgctgggggtgttgtcttccggcattatggccggcaacgtggtcggaccgctgctgggcggtgtgctaccgccactgatcgggattcgtcagactttctggctgaccggcgccgtgatttttctcgccttcctcgccaccacctttttactcaaagagcagccacgtgctcccgctacatcgcgcgccagccagcaaccgcatcctgaagccgggccggttaatcacagcctgatacggctgatgtggctctctggcatgttgctgatcttcgccagcatgtcgattgagccgattattacgctttacgtgggcgagtttgtgcagggcgaccaccagattaccctgatagccggactggtgatgtccgcggcggcgctgggcacggtcctggcggcaccacgactgggtcggctggccgatcgggtagggcactggcgggtgctgaccggcggtttagtcgttagcgggctgctgctgataccccaggcatttatcacggcggcctggcaactggtgctgctgcgttttcttatggggatggcgctgggcgggttgatgccgtgcatcacggcgatcattcgtcataacgtgccgggttcacaggttgggcggatgctgggatattcgacatcggcacaatatatcggccaggtcagcggcccgctgttcggtggactggtgggcggtgcattcgggatgcggccggtgtttctggcaacctgcgtggtgatgctgttttgcgcctggctcaactgtcgtggcatgaaaaagtagtgcgatcaaaaaaggcggaccggagtccgccttagtttattcacagctgcgtgaattacttctggtctggcagcgcgtaggcaatcacataatcgcccagcttggtaccaaacgagccgtgaccccctgccgcgatgacaacgtactgcttgccatccacttcataggtcattggtgtcgcctggccgcctgctggcagacgtgcctgccataacagttcgccggtatcagtgctgaaagcacgcaggtagttatctgcggtcgcaccaatgaagaacaccttacctgcggtggtgataggaccacccagcatcggcatacccattttgaacggcagcggaaccggtgcgctatcgcgaaacggtaccgatacgctgtttccacaccacgttgttggtcttcagatccaccgcggagatgtaaccccaggcaggctgtttgcatggcagaccaaatggtgacaggaacgggttcagctcgacgccatacggcacgccatactgaggctgaataccggtttcggtacctgaaccaccttcagcgcctttcggcggctcaatcgggttgcctgggccacgtggaatcagcttagagacaaacggcagcgccattgggttagcaatcgcgatctgacgatgaggatcgactgcgatgccgccccattcgaacataccgaggttacccgggaacaccagcgtaccctgctcagatggcggggtgaacggaccttcatagcgcaggcgcttgaagatcacgcggcacaccagttggtcaaacatcgttgcgccccacatatccttgtccgtgagattctgtttcggacggaaggtcagctcagagtagggctgagtggcggcaacgtgatcgcctttagcagcaccctgtggcactggcgtttctggcgcaggcacgactggcttgccggtacggcgatccagtacaaagatgttgccggttttcgctggcgcgtagacaaccggtacggtgttgccatctttgtcggtgatgtcagccagcgtaggctgcgacggcagatccatatcccacagatcgtgatgcacagtctgataagaccagaccagcttaccggtggtggcgttcagggccagcacgctgctcgcataacgctcctgctctggtgtgcggttaccgccccagatatccggtgtgctcacgcccatcggcaggtaaacggtatccagtttcggatcgtaaactgccggtgcccatgagttcggagagttcatggtgaaggtgtgttcatcagccggaatggcattaggatcttttgcgccaggatcaaacacccacagcagtttgccggtattcacatcaaagccacgaatcacgcctgacggctcgcgggttgagtagttatcggtaaccgcacccgccatcacgatggtggtgttagtaatcaccggcggtgaggtcggctcatactgacccgcagtggtgacaggctgtttgtgttgcagatccagctcgccgttgacgccaaatgccgggcagcgttcgccggtctctgcgtccagtgcaaacagacgaccatcgttgaccggcagatagatacgacgtgaacacagcgcaggctgagtgttcgctgcatcggcggctgccggcacttcgtggtaagaaacaccgcgacaggtcacgtgctggaaggtcgggttgaccttcatgcccggatcaaatttccacttctgcttaccggtggccgcatccagtgcaaacaggatctggtgtggcgaacagagataaagcgtgtcgcggattttaatcggcgtgacttcgtcggtaatttcacccggatcgttaggggttttcatgtcgccagtctggaactgccaggcaacctgcaactctttcacgttctggtgattaatctgcttcagcggagagaaacgggttccctgctgatcacgcgcataagcgggccagtcagcgtccgggatgttgctcagcggcgcagcctgcggtgcgttgtcagcggtttctggtactgacccgttgatgacctgcggatcgttgaataccgcataggccagcacaatggcactggcaatcagcgccacagccatggtacccagcgcggctttgctgcccgcattgaagctgcgatagacaaacggcaggatcagccagacaccgaagatcaccagcacatcggtgcgtggtgccagtgcccagaagtcggtgcccacttcccatacaccccagataagggtgccgatcagcagcagcgcatagagaaccagcgcagtgcttttacgacgggaaagcagataagcggtgataagcatcaccacaccgccaaaaacgtaataccaggaaccaccaatggcggctaaccagccaccgccaatcagcataaacgcgcccgtcagcactgcgaaacagcaccgtcaggaaacgaattacgccaaaagatgaggagtttttccccataatatcgacctcgtttcgttgccataaaacacacgaaaacaaccagataggctgtttccagttatcaagtacaaatgattagggtgttctgaagtatctcttccgttaagacagacgatccctttgtgttaaatgttatagcaaaatcagatcgaggtttgatttttttggcttaaaccgcttaacaactggaataaaacgacattttatgggggattaaaggacgttaagcgcaccgccgtgtgcccttaacgccggaaggcaggatttgtgaatcagcagctaataagatcgccgtccgagcgttgctgttgccagccgctgatatttatctcagcaaactgctcagcggttaagggcggcgtatgacttcgtacgattacctctgcccctttttcacgaaacgtcgccataaaaaagggaaaggtaaatttctcataattatcattaaagaaagattcggttaaaacaattcctgaaaaaggaaaagattccagtagtcgccagtctgcacccggtggcgcaaaatcataaagccagaaatcaaatttctttgttaattcaagcagtgacgtactgtgtgctgccagactggaataattaattccaatccggatacgcgcattttgtaaatgcgtataggcatccggaaccgcgatcattccccgtaatcgaatatcttccaccggcacaaccattaatgctgcttcagtagcaatttgattgtgtaatgaaataatgttgtttgtattaagtatattgccgctatcctggttttgctgaagataaggcacgctatagcaaatgccagtgacattaagcttaacgtgatggattggttcagtaacataggggttatataaactgtttttcattatctctatgaaattcaatagaaaggatttgttgttaattaagcatataaaaagtcgcatttttctaaacgcgtgaataaatatagatcacatgcttaatccaaatcatccttttgttgcctgagaaagtaaataaacctgttagcaaagaaacgataattcctttggcgtctgatgatgtgctggaatatattcaatagtcgggaccaataggctggtaataatcatgaggggtctgacgcgcctcggccggacagggacgctgcttatcgcgcagggaggctgcgctggagccgcaggccttctgctcgcatccggtctgctatcgtgaagccgacaatcaccacaccaataacaccgcgcaacgacgcgggtttcctcacctgatttgggataagacatgggatttatggcatcggcagcggaagagtcgctgtggcgacatcggacatttgtcgccttctgggtggcgcgtacctgctcatcatttggttttcagatgttctcggtcgcaatcagctggcagatctatgcgctgaccaacagcgcaatggcgttagggatgattggcttaatgcagtttctgccgtcggtgttgctggcgctgccagcgggccatctggcggatcaatatgaccggcggcggatcgtgctgttgggtcagctggtggaatttgccgcactgctggcattagtggtgcttaccttattccatacccccgataagaccgcgttgtgggggctggtgtttatgattgcggtggcgaaagcgctggagtggcctgcgatgtcttcgatgctgccgtcgctggtgccaccttcgattctggcgcgtgcgatggcgatgaactccgtgggcggtcaggcagcggttatcgtcgggccgacgattggcgggctgctttatgtcgccgggccgcatgtggtgtatggcgtttccgggctattttatctggtttcgctgacgctggtgagtctgctgcgttatgagcgtccggtgcaggctcgtctgcctatgaatatgaagaatctgtttgccgggattcactttatccgtgagcgcaaagatgtacttggggtaatttcgctcgatctgtttgcggtgcttttgggcggtgcaacggcgctgctgccgatttttgccaaagatattctgcataccgggccgtgggggttggggatgttgcgcggggcgccgtcggtgggagcattgctggtgggcatctggctgagccgtcacaagctggagaagcatgtcgggatgattatgtttggctcggtggcgggctttggcgttgccacgctggtgttcgcgctttccacgcagttatggctgtcgctggtggcgctctgtgcgctgggtggctttgatatggtgagtatggtgatccggggtgcgctggtgcagctggatacgccggataccatgcgcggtcgggtgaatgcggttaacgcgattttcattaatacgtcgaatcagctgggcgagtttgagtctgggttgctggcagcctggatgggtgcggcaccggcggcggcgattggcggcatcggtacgctggtggtggtggcgctgtggatgaagttgtttccgcatctgcggcgtcgtcagaagctggagaatgaggtggatccggtttgaacaaccgaggttggtgaggcagatgcggttgtagaattgagtgcagtctcagggagcctatgccttgcgcaaagacgcaaaagcgccatccattcgctgtgagtatgtaagttgcctctgactgaaacgcaaaccggacgaaacgcaaagctccgtgacgcctttcaaaacgttcctgatttacacgaaaacgcgttccttgctataacttatctctcatcggcaggcctgtggcctcctcagtcagcttaagcgcttatagagggtaccgttatgaatcagactcactccattccggaaatttataatcctgatgtgccgtattcagtaaagtgcgagatcgtggcgcagctgtgccgggcgctggcttcccataaaaacatcccggttagcgccctgagaaaatatcttctggaaaaaacgcacgttgatttcgaaaatctggaggataacccggtaggaatgctgctgctgtatgaataccttcactgccagcgcccctcggtctgcgcccggaatgaaaaaaaccttcattaagcgctgccttcagcttaatcaaatacgccttcggagaagagggctggagaaggggcggttgagttgtcgctggcaacggtttcccgagccagctcaacctcaatattgtcactggcccgaaggccagtacaggaagttaccagtcatactgccattaaaatcctggggtcagagggggaggccgacccgcaggctggggccatcaggccccggtttttcccaggttggcgtcaaatgttagccagctttcacgcatgtccactacgctgcgggttttacgagcctcatcgattttaattgccgtgaggcccgcttccagcgcgtccactactgaaactttcagcggtgttccctgtttaatatgtttaacgatctcttcagccatcagcgcatctgcgccgtaatggccatcatacgcattgccgctgtaggcggtatcgacctctttctcgccgctgcgcgcgttgtgtacgcggaagtagtttcgtacgaagtcgccttccgccatgccgtcggtgcccatgacacagaaacggcggaactcatccggcacattcagattggcgtggaaggccagcgtcgcgccgccttcgtactcaatcagggcagtctggtagtcgacaatatcggcatcgctgtcgaacaccgcatcggtgctcgaccagccgctgggcttcacgtgataaagttctgagtcagcggtgatagctccctgcggcgcatgagcgggagtaaaggatttccggccaccaaagctggcgacgcggatcgggcgctcctgcaacaggccctgatagagatcgatgtcgtgacagcatttttccagaatgtacgggccggcatatttctccagacgtcgccagtcgcgctgaaagaatgcgccgtgataaggcttgatatgttctgtcgcctcaatcgaggtgatctcacccaactgacccgcatcgcgtgccgccagcagatcgtgatagagcggggaatagcgcagtaccaggccgaccagaatgcgcgcttcgccatactgacgtaccagcttcgccatctccatggtctgctcttcattgatcaccaccggcttttcggtaaacaccgtgtaacccgctgccagcgcctgacccacatgctccagatgcagaaagttgggagagccaaccagcacgacatccattccgccatgttccagcagagcatcgattgacgcaaaggcctggccgggcgcgataccaaagctgtgcagattaggcagtccggcgggtgccggatcgtaataacccactaccgaaaaggcgtcgtcggctttgctgaactctttgatcacgtgggacagtcgaaagccgagaccgataatgcctactttcatgttaaacccctgctcctgaaatcgcatgatgcatagcccgcctgtgatcgggcgcgcctgttgataatctgaccaccaacttattacgacagaaaaactaatgtcaataacgcactgcgcgttttgcgaggggttttttgttatgatgatgtaaaataagaagaaaattcagatatgattttgctatatttatttgttattgcgatttaagtttttttatcctatcgttcgctcattatggctataacccttaatcagggaaggaagcgcgtgcaaccacactatcttctgggcattgatggcggcggtacacagtgtcgcgcgcggttaaccgacctgcagggtcgcattctggctgaagccaccggcgggcctgccaacgtctggtcagactatgacgcggcgctgacctgcgtcgggcagctgatcgaacgggtattgtcacaggcgggattagccccggaggcgctgacgcaaaccgcgctggtggccggattagccggtgcgaatgtcacctcggtacaggcgcggctcgccagctggcaacctgcctgcgcggcgttacaggtggtcagcgatgtggagatcgcctgtgcgggcgcccatggcggcgcacctggcgccgtctttattatcggcaccggcagtcagggagccgcgtgggatggcgatcagtttacgctgcttggcggctggggctttgccttgtctgaccagggatcgggcgctgagctgggccgtcgtgcgctgcggctggcgctgctggcccatgaagcgattattacccagagcgctcttacccggcagctgatggcgcagtttcgaccacagcccggaaaccatgctgctctggacgcgctcagcgacgcctgcagactgggcccgcgtggtgccacagatttttgcggccgccgacgcgggcgatggttatgcacaggatctgctgcatcagaccgcagccgatatcggcctgatggtccgccgtctgactgccctgagcagcggacccgtggcgctgatggggggactggccacgccgattcagcgctggctggatgacgatattcaggcccggctggtgacgccgcagggcgatgccctgagcggggcgctgatactagcgcagcagctgacgcctgcccgattaccgatctgaagctggctgagcatcctcagccagataacccgaggaatttatgaccgctcccaacgtaaccgcgcgcattctgcggttgattgttgaaaatgcgccgatcagccagtcagacctgaaaattcgtagcggactgagcatgtcgaccgtgtcgcaggcgactaatcgcctgctggcgcaggaaatcgtgcaggagctggggctgcgtcgcgtgtcgatgggacggccaaaaacgctgcttggactcaatcccgatcgcgccagcgtgattggcattcagctcaatgcagaacgcaacctgatcgtcatgaccgatctcagcggcaatctgctgggcgaacagcagatgccgaaaggcacgctgacaccgcgccagctcggcgatgcactggcgaaattcctgcgcggcgttgaggagaagcgggtgggcgccattggcctggccttgtcgggactggtcgatgccgaaaacggctactgtatccgctccaaagtgctcgactgggacaacgtcccgattgcgcgcctgctggaagagcgtttctcgctgccggtgtttatcgagaatgacgccaacgccatggcaatggcggcgctggtatttggtcagctcggcaacgcgcagtcggcggtgatcgccacctacggcaaagggatcggggcgggcatcattctgaatcgtcagctctaccgcggtcgtcacggcaaggcgggagagattggcaacgggctggtaggcgacggatcactgcgtctgctggaagatgtcgcctcatcgcgcgccattctgcaacggcttgctgaccaggagccggtggaaggcctcacgttgcaggcgctggatcagcggccaacgcccgaggtgctggcggtgctggaagaggcaggacgcgagctgggaatttcactggcgaacctgtcggtggcttacgatccggatgtagtttatctggcgatggagccgcacatggcgtcacgcattctgctcgatcacatcacccagagcttccaggcctatcggcttaaactgacgccgcacatgacgccgctgcagttcctgactgaatcgaaccgcatgtgggcgctgggcgcggcgggttttgccgtcaaccggctgcttgatctgctggcggcgcaggccgatgaagagccggtcacctgatttatccctcgaataaaaacgggcgccgcggcgcccgtttttgtttccgcgcttcccttagcgcaggcgcatcccctgttcatcaaacagcaggcagtgcgcagcagaaaagcccagttcaacctgggttcccagatcgcgcgtggttgcttcgcgctcttccaccaccagcatctcttcacgcccgatgtccaggtagaggtagttggtgtggcccagcatctcgccataggccagctcgccgtgaaagcgcaatgcctccggcgtctgcgcggcaggctgaaaatgctcgggacgaattcccagcgtcacggtttgcccctcgcggcagtcggcggcgattttcagcaccagcccctcaatcttcagttccggcacccgcagctgcacttcaccctcgcccgtggcgctgatttccgcccgcaggaagttcatttttggcgagccgataaaaccggcgacaaacaggttatccggatcgtgatagagcgtcagcggtgcgccgacctgctcaatgcggccctgacgcagcacgacgatgcggtcagccagcgtcatcgcttccagctgatcgtgggtgacataaatcattgtattgccgagcgaggcgtgcagccgcgcaatctcaatccgcatctgcaaacgcagctcggcatcgaggttagagagcggctcatcgaacaggaagatacgcggatgacggataattgcccggccaatcgccacgcgctgccgttgtccgccagagagcgcgcgcggcaggcggtcgagcagtttcggtgagatgcaggcgggcggccgtccgggcaatcgcctcgttgatctccgctttggactttttcattacctcaagcggataggccaggttaccgcgcaccgtcatgttggggtagagcgcataagactgaaacaccatagcaatgccgcgctcggtggcgggctgctgcgtcatgtcctgctcctcaatcagcaactgaccgctgctgatctcctccagcccggcgatcatccgcagcagtgtcgatttgccgcagccggatggcccgacaaacaccacaaattcgccgctgttgatcgtcagatcgatgccatgaatgacattaacgtgttcataagacttcttcacattctgcaagcgcaggctggtcatcggctacctcactcagagtaactggcccatgtagatggcattgctgcgcaggattggggtgaaccccatgcgctgataaaaggcacagacctgctcattctgcaggctgacgccaagatggacaccagtgacaccggcagcgcgcagcgccgccagctcatgctcaatcatccggcgaccccagccgcctttctgtgccgggggtagcaggttgatatgcagatgagcgggccactgcgtcaccagcgtgtcagcggcctggtcaggatggcgtattgcgtcgagcactttgctgtcgagcggcgcgctggcgctgcgatcacgatatttctcctgcagctgcggccaccattcggtctgtagctgcgcttcaaacgcgcgggtatcgggcgcggcgaccacataaccctgcacctcaccgtcccgctccagcacaaaagcaaagtcaggcgcgaaacgcgcataaggcacagcaaaacgctggccgggatagtcaggatcggaatagagcgcgcgggcatcgccacctgcatcggctgtttccaggcagatgcggtagagcgccgggtagtccgccggggtggccggacgaatgacaccttgattcgccatggtgaattctcgtgagtgagtgaatcggtcagggattgaacagatccgcagataaaagttacgttaatgaaagtggacttagttttcaagatagaataattaccttatctcactaacacgggcgcttcggcaatgtttaccggcatcgggatgcacaactgtgatcgccaacacgcccggatcgtggcggctggcagcagattcacggccagtgaaaggggaaagtgtgagcgtgataggattttcgtatgttttatcaggacgttattttgcaatgattgctctggcatctcctgctgcagaaaaagtagctggcgacgcaccgccacggttaatcgcgtaaatgccagcgcagtgtgctgaatttcacgccatgccgctgtttatttgcgcgtgctcacagcgttgtaattccccgcgcaggctgtttgactttatttttttattaaagtaagtatgagtgagtgcgtttgtgtgcggctgcagcctgcaggatgtcaggcggtgagatgaaaggatgccgatcctggtctgaagaaggtgagcataatgtctgtttcctccgttcgttcgttccgaattcgcaatgtgggtcggctgctggcagcgggcctgctggcgggcagcgtctcgcatgccgcccacgccgccgttaccctgaatgagtgggatatctacaactacccggagcagactgccgcggtggatgaagggattaaagagttttcccagcagaatcccggcattgtgattaaccgctcggttcactcctttgaagatacccgtattcccctgaagctggcgctgaccgccggtgatggcccgcagatcgctcaggtcaaccagggcggcggcgatatgggctcgctggttaaagataagctgctgctgccgctcgacagctacgccgccagcaacggctggaccacacgcttcccggactcgattctgaaacgtaaccgctggtcagacagcggcgagtttggcagcggcaaactctatggcgtcgccagcctgggcgagatggtcgggctctattacaacaaagcgctgctggataaagcaggtattgccgtgccgaaaacgctggctgagctggaaagcgcgatggcgaaactgaagcagcagggcaccgcgccgatgatgctcggtctgctggatggcaacatgggccagcagctgctcagcaccctgtggcaggcgcagattgagagccacgaccgcaagacgctggataatctgatttacgatgtgggcggcaccttcaaagacagcaagctggtcaatgccgcctctatgatgaagagctggaccgacaaagggtacttcttccctggcttccagggcatcggtcacgacgatgcggcgacgctgttccagaacggccaggctgcgttcctggtcagcggcacctggtatctcggccagtttaaagacaacaaagatattcactttgccgcgatgcctgccggtgaaggcgtgaagcaaccgctgatggtgggcggtaccgatctggcgttctccatcaccagcactgccaaaggcaaagaccagcaggaaggtgcggcgaagttcatcaactatatggtctctgatgccatggcgaaccgctggctgaaggtgggcttcctgcctgccagcaccaacaaagcggcgaaaatgccagcggacaatccgctgctggccgaggcgtatcaggtctggctgacgctcaatgattacgacggtttaggtcactacgtggactgggcgacacccaccatgaacgccgagctgaatcagaacgttcagctgctgctggcgggccgtcagacacccgatcagatggtagttaattttgataacaactatcagcgttacctgaaaacgctgaagcattaagccggaggcccggcgaaacagccgggcctgagcctcgttctgaaccacgagtagagttatgttgaatttaagtggctggcgtaattttctctatgttctgcctgcggtgctggtctatgcggtgtttctgctgttcccgctactggcctcgctgggcatcagttttaccgaatgggacggcacctcgctgccggtgtttagcggcgtcagcaactatctgcggatgttcagcgatccggtgttctggattgcgctgggcaataacgccatcctgatgctgttctataccctgttgccgattggcgtcggcctgctgctctgcagctttctgtatgacacgcgcaacaacagcgaacgcagcgtgctgcgcattctctttttcctgccctacatcatgccgatggcggtgctgggcgtggtgtggcgctggctctataacccggcgtttggtccgatcgaccagatattacgcgcaataggattgccccagctggcactctcctggctgggtgattttacctgggcgctgcccgccgtgggtctggtcgccacctggtacttcttcggcttctgtctggttctgtttatggcgggcctgcagcgcatggatccctcactgctggaagcggccgatctcgatggctcgtcgcgtcgccagaagtttatgcgcattacgctgccaggcctgcgacccgagctgcggattgccctgctgctgacggtgatcgccagcctgaaagcctttgacctggtctatgtgatgacgcagggcggcccgggcacctccaccatggtgaccaacatctttatgtataagcagggctttgatctgcactactttggctacgcctcgtcggtagcggtgttcagcatggtcattgttttagggattaactatctgatccatctggccttaaaggagcgttactgatgcgaagcacgccggtgatttcacgcgcgctgatctggatcgtggcgcttatgacgattctgccgttcctgatggcgctgatgacgtcgttcaaaacccagatggagctgtttcagggggtcttcacgctgcccgcctcgctgaatttcaaaaactacctgaccgcgtggcaacagggacacttcaacgtctacttcctcaactcagtgctggtggtgattccggtggtgctgttcagcgtgctgctgggcattctggccgggttcggtttcgcgtggctgaaaatccctggtaaaaaagtcatcggagcgatgctggcgctggggatggtgttgccgagtgaagcctttatcattccgctctatcacgagctgcgctggatggggctgaccaacacctatctggcgctgatcctgccgcaaatcgccctgtcgctgccctttaccacgctgatgatcgccagtgctttccagcaggtgccgaaagaaactggtggaagcggcggtaatggatggggcatcgcgggtcaaaattctgtggggcattctggtgcccgctatctggccgaccctctcaacgctggggctgctgctgtttatctggacctggaatgagttcctgatcccgctgattctggtcaacaaggatgagttacgcacactgccaattggcatgatgtttttccagaacaaaaacaccatcgacattccggtgctgatggcgggcgcgatgattgtgattatgccgctgatcgtggtgttcctgattttccagcgcaagttcatcagcggcgtcaccgaaggggccgtgaagtaatctgtgatagcccgcacgaaacggcgcactggcggccagacaaaggtttgccgcgccgtatcgtgctgcaattcctcctcctcaatcctgcgggagacgcatgatgcacctttcccttgctgattttcaccctgtcgccgatggcgaaaccccggacacggccgtgctgcaacgcgctatggatcagattgcggcggcgggcggtggccgtctgaccctgcctgccgggcgttatcgcagcggctgcctgaatctgccctctgattttgaactccatcttgaagcgggcgcggtgctgatcgccagtcagcggctggctgattaccaggcggtacaggcgctgagctgtgctgagaagtcccacaatgtgctgctctatgcgctgggccagcgcaatatcaccatcagcggcaccggccgtatagacggtgacggtgaagcctggtttgccgctgagcgtgacgagcagggctatcgcctgccgcgtgcggaccggccgcggatcattgtgtttgaagattgtgagcaggtaacgctgaccgcttttaccatcgtgcaggcgccgatgtggacggtgcatctggtgagctgtcgccatgtgcatatcgaccacctcaccatcgacaatgccatgaccatgccgaataccgatgcgctcgatatcgacagctgcgaagcggtgtttgtcagcaatagctatctcagtgccgccgatgatgccatctgcatcaaaaccacccataaaccggccgcgctgcggcgtccggcgcggcagattatgatcaccaactgcctgctgcgtagctacagctgcgcctttaaaatcggcactgaaacctgggatgatgtggaagatgtcacggtgaccggctgcaccatttttgattccaaccgtggcattggcattctgtcgcgtgacggcggcgcgatgcggcgtctgctgttcagtaatctgacttttgcctgtcaccatgcgccgccctgtcactggggaaaagccgatccgctgcatatttcggtgcgcaggcgcgatcccgccattacgcccggcatcgtagagcaggtgcagttcagtaacgttacgggcgtggcggaaggggcgattaacctgcatgccgcagaaccgggctggatacgcgatgtggtcatcagccagctgcaaatgcggcagatcgtggcaccggttgcacagggacactatgacgtgcggccgccctgtaatccggactccccgaccggcatggggctggataacgcctacaaacttgacccgaaaaccggcgaagcttttggcgtagagcgctatcccggcgggctgccgggcctgtttgcacgcggggtggagaacctgcaactgcacagcctggcgatagtacggccggaaccgttaccgccaggctggcaccccgagtgtgtggtgcagttgccggactaaatcacagcgcggcggcgatggccataccaagctgttcggtgctggcgctgccgccgagatcgcgcgtcaggtgctcacccgctgccagcgtgcgttcaatcgcgtctaacaccgcatcacctgccgctttgtagccgaggtgctccagcatcatcgcgccacaccagatctgtccgatgggattggcgacgcctttaccggcgatatcgggcgcagaaccgtgaaccggttcaaacaggctggggaacaggccttccggattgatattggccgaaggggcgatgccgatggtgccggtacaggccgggccaagatcggagaggatatcgccaaacagattgctggcgaccaccacatcaaaccagtccggatgcagcacgaagttagcggtgagaatatcgatgtgatacttatcgacgcgaacctcggggaaactgaccggccatggcttcaacgcggctatcccagtagggcatggtgatggcaatgccgttcgatttggtggcggaggtcaggtgtttcttcggccgactctgtgccagctgataggcaaacttcaggatgcgatcgacgccggtgcgcgtcatcaccgtctcctgaatcaccacttcacgttcggtgccggggaacatggtgccgccgacgctggagtattcaccctcagtgttttcgcgtaccacatagaagtcgatatcgccgggctgacgattcgccagcggcgctttgacgcctggcatcagtcgcaccggacgcagattcacatattgatcgaactcccggcggaactgcagcagcgagccccacagtgaaacgtggtcgggcaccacatcgggccagccgactgcgccaaaatagattgcatcaaaggctttcagctgtggaaaccagtcgtcaggcaacattttgccatgctgctgccagtagtcggcactggcgtaatcgaaccactcccagcgcagcggaatgttaaatttctctgcggccgcattcattacacggacgccttccggcatcacttctttgccgatgccgtcgccagggatcacggcaacagagtgaattttgtcagtcacagggtacctttccggttgatgttcgaattgtgtacgcagtataactgtcgcttccggggaaataatgagcctgaaaggcaatccagtgttgaataaaagtagagaatcccgcacctccaccgatgatttagccttctttgttcgcctggctgcgctggatagcctgactgcggcggcgcgcgaactgggactgtcgctggcggcggtcagcaaacgtctgagccagcttgaacagcggcttggtgtgcaactcctgcgccgcaccacgcgacgactggagctgacgccggaagggcgccgatatctggcgggtgcgcgtccgttgctggatcagctggcggcgctggaagaggcggtcagcggcgaaaccgctcagctgcgcggcacacttaacatcaacgcctcatttggctttggccgtcggcatattgcgccctgcgtttcggcttttgccgcgctgcacccggaactctcgctatcgctgcagctcagcagccagccacttaattttcttgatgcccacatggatattgatatccgcgtcggagaaccgcccgactcacggctggtggcgcgcaaactgcgtaccaatccgcgcattctctgctgctcacctgcctatgccgcccggcacggtctgccagagacagtgcgcgatctggcacaacacaactgcattttactgcgccagcacgacagcgattttaccctgtggcgactgaccagcggcgaacagagcatcaatcagaaagtgcgcggcagtcttatcaccaacgatggcgaagtggcgatgcgactggcgatggatgggcatggcatcttgctgcgttcctggtgggacgcgcagcacagtctggcgacgggcgaaactgctgccggtgttacccgactggcaggcaccggatggcgatatttttgcggtctggcaggcgcagcgtcagcttccggcgcgtattaccgcatttgtggcgtttctgcagagcaatctgcaatcggttgattagccaggcttttaaaggcagtttctggtgcggccagacgcctgcggacaatatacataccgcattaagctgattcggttgcgtcagcgtgccgctgcgtttacagcgttttagcggctgcgtatgattcttattctttttatttccagcctgtcctctgcgttgtggccagccgggagcagcaagcagataggggagttaagtatgaaagcgttgttcagtccgcgtacagcggcacttacactggcgatggtgaccaccttcagcctgacggcgtgccagatgccggcgaaaaaagtggatgccagcgcgccggtggtgatgcagccctccagcccggataacctgattcagcgcgagctgggtgaaggtttgtatgagatggcctatctgccagcaaaaaacgccctctatgtcgccagcgcgcagggatttaaagatatcagcggcggcatgatctaccgtcttgatgcttccacgctgcagagcaccggcgcgggacacttcgacctgaaaaactttggtctgatcagtgcgcctgacggcagcgcactctacgccaccaacacgctggatggcggtatctctaaaatcgatcctgataacggtaaggtgctgaagcgcctgatgtttgacgagaaaaatgagaaaggcatgccctatggcacgcgtgaaatctttctgcatgacgggctgctctatgtcggcggcgtgggcgatccgggcgtgatctgggtggttgatgccaaaaccctgacgctgaaaacccggataaaaaatgccgggaagtgggtcacaggcatcatcttctcgccggtcagcgaccggatttatgcggctaacggcagcggggaaatcctggtgatcaatccgcgcaataacaaaatcgagcagcgcctgacggcgggtgacgggcaggagtatctgttcctgaatatggccgaggatccggcaaccggtcgcctgtttgttacggataattcaaaagcgaaaaatacgctggtgtttgatgagcgcagcggcaaggtcattaagcgtctgaatccgggcgactcactggggattaagtttaatggcaagcgcaatgagatttatatcagccagcgcgaatcgaagaaggtgctgcagctggatggcaccacctatgaggtgaaaaacagctggtcatttgatagccaccccaacagtctgctggtctcaccggacgggcagaccctgttcgtcaccctgaagcagggcttcaatgacgatcacagcagtcaggggctggatggcgtggcgcgtatcacactgcaataagaaaaggcggcatcgctgccgcctgcatctttacttagccacaccttctaccagcaccacgcgatagttcgcgcctttcagacggtgcgctttggcagcctgatattccgggctgtcataccaggcatgtgcggcttcgcggctcgcgaattccagaatcaccacgccttccgcttcctgcccttccagcgtttccagttcgccataaaaggcgagaggattgatctgatgatcgccgcgagcctcgcccgctttctcggcatagatcgccatttcgtcctggttcagggtgttatcacgaataaatacaacatatgcactcacaggtctctccttaagcttttttatcctgggttttggtatcgaagtcagcggcatcatgacgctcgtgcagctgatcggccgggtcgcccatgacacggttgaccttgcggccacgaatcacagcaggtcgcagcgcgatctctttcgcccagcgcactacatttttataggagtgcacatccaggaattcggcaccgccatactggtcattcagcaccatgttgccgtaccacggccaggtggcgatatcagcgatggtgtagtcatcaccggccagatagcggttatctgccagctgacgatccagcacgtcgagctgacgcttcgcttccagcgtgaagcggttaatggcgtactcaattttttctggcgcgtagtgatagaaatgaccgaaaccaccgccgaggtaaggcgctgagccctgtaaccagaagagccagttcagggtttcggtgcggccagcgatatctttcggcaggaagtagccatacttctccgcaagatagagcaggatgttgcccgattcaaatacccgaatcggcggcgttgctgagtggtcgctcagcgccgggattttcgagttcgggtttacgtcgacaaaaccgctggagaactgatcgccttcgccgatacggatcagccaggcatcatattccgcatcgttgacgttaagcgccagcagtttcttccagcaggatggtcactttctggccgttaggcgtgccaagcgaatagagctgtaaaggatgcttgccgaccggcaacgctttttcatgggtgggaccagcgaacggacgattagttttagcgccgttacctttggcttcagggtcccaggtccagacttttgcgggctgatatgcattttccgacataatgaaagttcgccttatggtgtggtattggtctggagtgtagcaggtgctgcgaagggggtttaactctgctggctgcgcaaggccgtgctgcagggggctgatgtcaggcgggcagcggcacaggagaaaagtgaataaaagtgtgtcaggcgggtggttcgttatcctgagcggaggtggccgtgcagtcagaagcgactgcacggcaggcagggttacagcagttcacgctcaatcagttcgcgggtttctaccgcctgaaccttcatcttttccgggtagccaaacagagacgccgcgatgatcggttcaccgccgactttataactgcgggtggcaaagccggtgtcgcgcagcgttttaaacagggtgtcgaagtccacttcgccttcgcccacgccgacatgctggtgaatggtggcatccacccctggcgggttaacgatgtagcgacagtgttttgtatggttcatggtgtcggcgatcagcatgtgtgacagatcgtcaccggcatactccagcatcggtttcacatcacctttgcctttgtcataaaagaaagtgtgtggtgcgctataaatatacttcacgttatcgctgcgaaacgacttcacgatatccacggtttcgttgttctcttcgcagaaatcccatggatgcgcctggatttcgacgcggatgccttcacgttcgatgattggcagcagctcttccatggagcgatagaacatctcttcacagatttccggctcgttaggcgtgccggagagctcggtgttgatcacctgcacacccatctcaaccgcgatctcgatcatccgcttccagttcttcaccgccgcctgacgacgcagctcatccgggccggaccagcgatagaccacgataaacgaggagatctccagcccggtggcgtttaacgcattcttatactcggtgatgatttcacggctggctttaggatgtttataaaacgggttgatctgcggatgcggcgactgttcgatatatttgtatccccagtcggccacctgatgaaccatacgggtgatgcctaaatctttaatcacatccacatcaaaagcgattttcatctttctgctccgggcacattaaggttgctgttcttcattgaaggtcacgccaatctgctgcctgacgttgtccatcgtggccagggtggtaatcgcctggtcaagcgaatggatgggtgaatcgatccggttctgaccgatacaccaggcgaaatggttaatttcatgacagagctgttcatagcggctggcaggctcctgccactgcaggcgatgacgccgatcgctggaggtcagggtgaagttaccaggcgcatagaactggcctgaaagttccagcgtggcctcgcgtccggcgatcaccgcgccgcctggcgtgttgctgaacagggtggtattcagcaacgaatgcatgccgtgctgatgggtaaacagcatcgacgtctgaccgtttacacgcccagccgggacgggctggccccgggcgacgatcgtgtcaggcgcaccgccgccaacaaacacgctaagcgccaccagatagctgcccagatccagcatcgggccgcccgccagatcggcgttgaagatgcgatggtctggtgtgaaaaactcgccatgatcggcaatcagggtgtgaacatcgccgagcacgccatcctccagcagctgacggataacgtcatatttcggtgtgaagttgcaccacatcgcctccatacagagcaggtttcgcggcagcggcggccagtttaagctgtgtcgcctgctgagcattcagcgccagcggcttttcaatcagcagatgctttccggcggcaatcgcgcgcagaccatcgggaaaatggtggttgtggggcgtagcgatatagaccgcatcaacatcctcccgcgccagcagcacgtcgatactgcccgtggcatggctgattgaccatttgtcggcaaaggcctgtgcttttgccgggtcacgcgcagccaccgccgtgatctgctggtgggtatgcttgcgcagtgcatgggcaaaatggtcggcgatccagcccggcccgataatgccccagcgcaactgtggtacctggctggcagcggtcaggcgtggaaccggaagcgttgaagggaacataacttttccttttatacgtgcaggcaggtgctgctcagggctccactatagaaagcccgccgtcgtcgctctaaccttttaatgatgtgatcccatcaacccgatcggcgcaggatttttatccgttttagcaaatgggcgttttaaagagaatgcagaaagaaatgaatgtttcattttgcgaggacgatcaagattaacgctgactttctatcaaataaatgagaggaaatggctgtgccgcgatagagtgttaatgtctcagacaacagaatatataggcgtagccgtcagccagcgctacaaagagcagaagcagggagaaggatgatgtcaaaagtgacgatgaccgctattgcgcaggcggcgggcgtgggcgtggccaccgtggatcgggtgctgaatggacgcgcgccggtgcgcagcgtgaccgagcagaaagtgctggctgcggcccgcgagctgggctatcacctgacgcaggcacacatccggacaacatcgccgctcgctgcggcaacagtttcgcgtgagctttatcctgctgcctgcccgttattcgttttatcagcagctaggcgaggtgctgaaacagcagctgaaggcgcagcagccacagggcagcgaacctgaattctgctggcatgatattcatgaagtggaggcggtggcgcactcgctgcgtctgctggcacagcgcagtgatgtgattgcgctggtggcgctggatcatccgctgattcgtcacgcgattcaggatgtgtcacgactgggcgtacgggtttacgcgctcttttctgatttctcgccctgtgagcatgcggggtttatcggcattgataatcagaaagcgggacgtacggcggcctggatggcacagcatctgctgcgtcagccgggatgcgttggggtgctgctgggcgatcaccgctttacctgccaggagagcagcgagatcagtttccgctcttacctgcgcgagtcaggcatcagccagcgggtactggaaccgttaaaaacgcatgagtcgggtgaaggaggctatcaggcgacccggcagttgctggacacccatgatgatctggtgatgatttatgcgccctgcggcggcatagagggcgtggtgcaggcgctgcgtgacagcggacgcaggcagatcgatctgctgtgccacggtccgctgcccggcgatgagctggcgctgattgatggcaccattacgctgatgttgcgccatcgtattgatgccatggctgcggcggtgatcgccacctgcctcaacagccggatggaacagcgcgaccattttgctcagatgaccgtaccctttgaaatcgtgacgcgtgaaaacctgtagaaagagcaggttagcgggtatttgatagaaaactatcatataaagaaatatttaaacgcgatctctatcaaaaaatgaaactttcattgttgtctgagatgaaattttcatttgatactgccagcagttctcactgcacaggcagatatcatgacctttcacattgctaatgcgccctgtagctggggcgtcgacgatcccgctaatccctggctgccgccatggcagaaagtcctgactgaagccgctctggctggctatcccagtatcgaacttggcccctggggctatctgccagcggatgcagccgaaactgacccggcagcttaatgcgcatcagctttcgctggtggcgggtacgatttttgatgatttggtcagtgaagcgcatttccctgaactggtgacgctgacccacaacctgtgccgtaccctggccagtgtgccaaccgccgccagaacgcccggcgccagcgcgccttatctggtgatcatcgacttcgggaatccggagcgggcgaaatatgccggtcagtcagaaaaagcgccacggctctccgctgacgactggcagcgcatgatgcgacacatcaccattctcagtgagattgcctggcaggagtatggcgtgcgaccggtgatccatccgcatgcgggcggctgcattgagtttgccgatgagcttgcgcggctggtcagtgatattccgcatcaggtggctggtttatgcctggataccggccatctctattacgccgggatggatccggtcgcttcgctgcaacagtactggacccgcatcgattacctccacttcaaagacgttaaccagcgggtctggcgagacgccctctctcacggactcgactttttcactgcctgcgcgcagggggtgatgtgtccgctggggcagggcgcaattgactatccggcggtgcgcacgctgctgactgagcgtaactatcagggctggatcaccatcgaacaggagcgtgatccgcgccatgccgacaccagtctgcgggatgttaaagccagcctggactatctccgatcaacaggattctgaggacaacagcatgattaacggtaaaaaagcggctaatcgctcgctgcgctggggcatgatcggcggcggcggcaccagccagattgggtatatccatcgctctgcggcacagcgtgacggaaactttgtgctgctggcgggggcgtttgatattgatgccgcacgcgggcgtgagtttggtcaggcgctgggtgtggcaccggaccgctgttatcccgattatgccagcctgttcgccggggaagccgcgcgtgaagatggcattgaggcggtgtctgtcgccacgcctaataatactcatttcgccatttgccgcgcggcgcttaatgccgggctgcatgtggtgtgcgagaagcccctctgttttacggtcgaagaggcggatgagctggagcagctgagccgggagaagcagaaggttgttggcgtcacctacggttacgccgggcatcagctggttcatcaagccagggaaatgatcgccgaaggggctttgggtgagatccgcatcgttaacatgcagtttgcccacggcttccataatgaggcagtggagttgcagagtgaaagcacccgctggcgggttgatccgcgctttgtcggcccgagttacgtgttaggcgacctggcgacgcatccgttatttatcgcagaaacgatgttgccacagctgaaagtgacgcgtctgctctgttcgcgtcagagctttgtcgcgtcgcgtgcgccgctggaggacaacgcctttgtgatgatggagtatgacaacggcgcagtcggcacgttatgggcgtcggcggtgaatgccggatcgatgcacgggcagaagattcgggtcgtcggatcgaaagccagtctggaatggtgggatgagcagccgaaccagttgcgctatgaagtgcagggcgagccagtgcgcattctggagcgcggcatgggctatcttaatccgcgcgcgctggaagaggaccgcattggcggagggcataccgaggggttatttgaagcctggtccaatctttatcgtcgcttcgcgctggcgatggatgccaccgatcgccgtgacaccgacttcctgcaggatttctggtatcccgacgtgcatgccggattaatgggcgtgcgctgggtcgcgcagtgcgtgaaatcggcggatgccggtgcagtgtgggtggcgtgctgaagcagagggcgagccacaggatgtggcgagtgtatcgaaccttcgataacgggtttgctccacaaaagcaaaaaacccgccagaggcgggttctttaaatatggtgcccgaacccggacaaaaatgccgggagcatttttgcatcgcgcggcttcgcgcgacccggagggtgagccacaggatgtggcgagtgtatcgaaaccttcgataacgggttcgctccacaaaagcaaaaacccgccagaggcgggttctttaaatatggtgcccgaacccggacaaaaatgccgggagcatttttgcatcgcgcggcttcgcgcgacccggagggtgagccacaggatgtggcgagtgtatcgaaccttcgataacgggttcgttccacaaaagcaaaaacccgccagaggcgggttctttaaatatggtgcccgaacccggaatcgaaccagggacacggggattttcaatcccctgctctaccgactgagctattcgggcaacggggcgcattaaaccgtaaaggccgcgggtcgtcaacggctttcaccaaaaaacccctggaaacgtgactgattgcctgattttcagtcaaagcgggtaaaacctcaggccagcgcgccatttttacggcatagcgcgatgctgtaaacatcctccgccagccgctgtgcggtggcgacatcctgcacattgcgcttcaccagcagcttgctgaggcagccttcaagaatcagctccatctgatcggccaccatgctggggttgtccagcgcctgctccaccagaatgtcgtaggtgaactgccatgagccgcgtttctgctgttcggccagttgatggatgggctgatcgggctgcgggtagaagctacaggcggcaataaacaggcagcctggaaagcgtcctttgctgacctgctcactcaggacctcatagcgtgccatcagcttctggtcgggcgacagcgattcatccagcaggatctggcgtcgccaggtatcaatctgctgcccgtgatagcgcagcgcatcgtagagcagggcgtcacgatcgggccagaactgctgaagctggtcacgggttaattcggatcccgccagggtttccaatgagagggtggcggcgaggccgttctgttcaagcacattcaatgcatgctcgagtatctgttcacgctgcaagtgactctcctctggtatgcaggcccggtaaggcaccgggcaatgacctgactccagtgttgtttacggggtaagtttctgcaaatgcgcccggaagtcggcggcattgagaaacccggtgatgcgcgatccggcgatttcgcggccctgcgcatcaaagaacaaaatcgtcggtaagcccagcacctgaaggtgctgcaacagcgcgttatcactggcgttgttggcggtgacgttggcctggagcagctgtacctgactcaggctatcgcgcacggcgctgtcactaaaggtatatttttcaaactctttgcaggcgacgcaccagtcagcgtagagatcgaccatggtgatgcggccgcgggcctgctgcagcgcgctatcaagctgctgcggcgtctggatagtatggaacggcagcggtgccacagcctgctgctgcgccggtccgccaaaggcccagtcctgcaacgggcgtgcgctgatcagcgcagcggccagcatgataatctgcactacgcgccacttaccgctgctggcgcgcaggctgacgctgaacgcccagccaaagaacgccaggccgagcaggctccagagccgcaatccccacgcatcgcccagcacccgctccagcaggaagaccggcagcgccaggatgacaaaaccaaagccctctttaacggtttgcatccacgggccgcttttcggcagcaaccggttaccaaacagggtcacggcgatcagcggtaatcccattccgaccgcatagagccacagcgtcccggcaccggcccacagatttccgctctgcgcgatgtaaagcagaatagcgctgagcggggcggtggtgcagggcgagcagatcaaacccgccagcgcgcccatcaggaagacgccgggcagcgagccaccctgctgacgattactccacagagtcaggcgggtttgcatgctggcgggcagttgcagcgtaaacaggccgaacatcgacagcgccagcacgataaacagcagtgagagcgtgaacagcacataaggatgctgcaacgcggcctggaagcgcaggcccgctgccgcgacgacgactcccagcagcgtgtaggtcagcgccatcccctgcacatagaccatcgccagcgcgaacagccggcccagcgaatagtggcgctgaccgccaaggataatgccggagatcagcggatacatcggcagtacgcagggcgtaaacgcgacaccgataccaatcagtagcgcccagagcggcgagaaaggcagcgggctggcgggcgcgggctgagcgctgaccggcggcggtgcgctgctggcggttaccgcacttaccggaacgctgcgcgtctctggcggataacagaatccggcggcggcacagccctgataagtcacactgagcgtggcgccgctggccgcctgttgcagcgtcaccggcagcgtcagatcctgcggatagatttcacttttgccgaagaattcatcttcatgcggctgaccagccggcagcgttaacggcgcgatggtcgcgtttctgcggtgtgatgtggatctgctggcgatagaggtagtaacccgatttcactttccagtgcaggttgagctgcgcgccctgctggtcgaagtcaaaagtaaaggcctgatcgaccggcacaaagcgactggtcgccggatttgaaaagagtgaagcgtgcgcctgcaggccgataaacagcgtcagcagaagcgtaattaagcgagagatgcgtgcagccatgacaagtattcactgtctccatattgaaccggcagcgccagcagttcgggcacatcgtaagggtgagcgtctttgagcagatcacacagcgcctgctgatgatcgctgtcgcatttcagcagcatctggacttcgctgctctgctccatttttccctgccagagataccaggaggtggcgcccggcagcagtgtgacacaggccgccagcctggcttccagcgctaagccagcaaggtgctccgccgtggcctgatcgggcgtggtgcagaggatcacgacagcattcatcctgtgactcctgttttaaagagcgccgatgatagcacgctccatccgtaacacgaggagtgtgcttatagcagcaatccgccaaaaacgaagccagagagcaccgacagcgcaatggcgatcacgccgggaatgataaaggcatggttaaacacatacttgccaatccgggttgaacccgtgtcatccatctcgacggcggccagcagggtcgggtaggtcggcagcacaaacagcgccgaaaccgccgcgaaggaagcgatggcagtaagcggcgtaacgcccagcagcagcgcggcgggcatcagcgctttggtagtcgcagcctgcgagtagagcagcatcgaggcgaagaacagcaccagcgccagcatccacggataggttttcagcgtgtcgcccgccagcatctgaatctccgccagatgtgccttcacaaaggtatcgcccagccaggcgacgcccattacgcagatacaggcgctcatgccggacttgaaggtgctggcgctgaggatttcgctggtgtcgagtttgcaggtcaggctgatcagcgtggcgatggtcagcataaacaccacaatcgcttcattgcgtggcagtggcggattgacgatcagcccgacgctggcgctggtcgcggtggcataaagcaccacggccacgatgcccgtcagaaacagcagcaccgattttttcgcgcccggttttgcctggtagaggctggcgccgcgcagcgtgacttcgcctttggcgagacgcgcctgataaacctcatcatcctttagctcacggcctaagaagttagtcaccagagccgccaggaagaggcccaccatggttgaggggatggcaatcgccagcagcgtgatatagctgacgccgcgcggctcaagcaaagtggcgaagaaaaccactgcggctgaaatgggtgatgcggtaatcgcgatctgcgaagccactaccgcaatcgacagcggccgggaagggcgaacgccttgctctttcgccacttctgcaatcaccggtaatgttgagaacgcggtatgtccggtaccggccagtagcgtcatcaggtaggtcactagtggggccagcagcgtaacgtggcgtggatggcggcgcagcaggcgttccgccagactcaccagataatccatcccgcctgccacctgcatggcggctatcgcggcgatcaccgccatgatgatttcaatcacatcgaacggaatagcgccgggtgccatgccaaatcccagcgtcaggatcagcacgcccattccgcctgcgaaacccgataccaatgccgccaagacgtgcgcccaaccagatcgccatcaagacgataagcagctcaaccacaaacatgaatgactcctgaaagataaaccggtaatagccgggtgtgctgtttaacaaaaaaaaaggcacaccgtgttgatcgcggtgtgcctttggttaaccagcgtcggttaaaccttactgttcgttttcatcagtataacgtttggctttataaaccgggtacatcaggttctgcaccgagaagatatcgtccagctcactttccgtcagcaggccgcgctccagcacgacttcacgtacgcttttaccggtttccgcacagattttgccgacgatgtcgccgttgtggtggccgatgtaagggttaaggtaagtcacgataccaatcgagttgaagacataggcttcgcacaccgcgcggttggcggtaatgccgttgatgcacttctccagcaggttgtagcaggcgttagtcagaatgctgatcgactcaaacagcgcctggccaatcaccggctccatcacgttgagctgcagctggcccgcttcagaggccatcgtcacggtgatgtcgttgccaatcactttgaagcaaacctggtttaccacctccggtacaaccggattgaccttggcgggcatgatagaggaacccgcctgcagctctggcaggttgatttcattcagaccagcacgcgggcctgaggagagcaggcgcagatcgttacagattttagagagcttcaccgccagacgtttcagcgatgaatggaccatcacataggcgccacagtcggaggttgcttcaatcagatcttccgctggcaccaccggcaggttgctgacttccgccagacgctgtaccgccaggtgctgatacccttccggcgtattgaggcgggtgccgatggcggtcgcgcccaggttcacttccagcagcagttccgcggtgcgcagaatgcttttggtctcttcgttcagcagtacgctgaaggcgtgaaattcctgcccgagggtcatcggcacggcatcctgcaactgggtacggcccattttcaggatggtctggaactcatcggctttgtgctggaagccttcggccagctggctgatgccatcaagcagtttcagtagcgagctgtagaccgcgatgcggaaaccggttgggtaagcgtcgttggtggactggcatttgttcacatgatcgttggggttgaggtactgatattcccctttctggtggcccatcagctcaaggccgatattcgccagtacttcattggtgttcatgttgaccgaggttccggcaccgccctgataaacatccacggggaactggtccatacagcggccgttgttaagcacttcgtcgcaggccttaatgatggtatcggcaatgttgcgcgggatggtctgcagctctttgttggccatcgccgccgctttttttaccatcaccatgccgcggacaaattcaggtatgtcgctgattttgctgttgctgatataaaaattctcaatcgcacgcagagtatgaacgccataataggcatccgccggaacttcgcgcatacctaacaggtcttcttcgatacgaatgttgttcgccatgataaccttcttgttgttgccgctaaccatcacaaaggatgtgtttattttgtcgtggtgtacccgtgccgacatattatccgtcttcataggggcgtgtgcgatcatattctgatgcatatgaaaagcacgcatgcagatcacttaatgctgcagcctggttaacgatatgtgaagttggttacaaaattaaccccgcaggataaatttgacaggatcggttgaaaatggcggcgcgggtgcccatctcttttcttatcatcctcaggatgaacgctttctgctgaccggcacgctgccgttcagcccctacttacaggagagtacggtgcgctggataccgttattagtctttttcgttctggcctggattgagatttccctcttcattcaggttgcacacgtcatgggcgtgctgcttaccatgctgctggtggtcttcacctcgtgcatcggcgtctcgctggtcaaaaatcagggcatgaaaaactttatgctgatgcaggagaagctggcacgtaatgaaagcccggccaatgagatgatcaaaagcgtgtcgctgatcatcgccggtttcctgctgctgctgcctggtttctttaccgacctgctgggcctgctgctgctgctgccaccggtgcagaaacatctgacgctgaagctgatgcctcatctgcgcgtctggcggggaccgggagccggtccagacagcggctacaccatggatggcgagttcgagcgtaaagacagcgatcgccttgagcatcatgacgatcacaaggatcgttaaccgcagctgtcacctttgaaagcgcaaccctcgggttgcgtgagattgttgaaaaacctgacccggccagctgtgagaccggagccgcacagggaacagggtcagatcggaaagtcgcaaaatcgtcatccatgactgctcggcccgcgccatccgtggcgcgggacgctttcctcttctgaccctgtttcctgcgccctgagcttagccgttgctgccagggtcatcctgttctgagtttgtcagcacgctggcgcaaccttcgggttgcgttttttatttgccccatcatctgttcaaaaagccatcacttatcactcacacgtaaaaaatttgttgtccgcccccttgaaagtgggtggtagcggccctatctctctggtcacgaggccggaagccatgcagcccggtgttcaaccccaaaactgaatgattggacttctcaaaggagagctatcaaatgaaaattcgtccattgcacgatcgcgttatcgtcaagcgtaaagaagttgaagctaaatcagctggcggcatcgtgctgaccggttccgcagccggtaaatccacccgtggtgaagtactggctgtcggcaatggccgcatccttgagagtggcgacgttaagccgctggacgtgaaggttggcgacatcgtgatcttcagcgaaggttacggcgcgaaaaccgagaaaatcgacaacgaagaggtgcttatcatctctgagagcgacattctggccgttgttgaagcgtaatttttacgcgtaattcactgaacgaaacgaatttaagggatatttaaagatggcagctaaagacgtaaaattcggtaatgacgcacgcgtaaaaatgctgcgtggcgtgaacgtactggcagatgcagtaaaagttaccctgggtcctaaaggccgtaacgtagtcctggataaatcttttggtgcaccgaccatcactaaagatggtgtttctgttgcacgtgaaatcgagctggaagacaagttcgagaacatgggcgcgcagatggtgaaagaagttgcctctaaagcgaaacgacgctgcgggcgacggtaccaccactgcaaccgtactggcacagtctatcatcaccgaaggcctgaaagcggtcgcagcgggtatgaacccgatggacctgaagcgcggtattgaccaggctgttatcgctgcggttgagaaactgaaagcgctgtctgttccttgctctgactctaaagcgattgcgcaggtaggtactatctctgctaactccgatgaaaccgtgggccagctgattgctcaggcgatggagaaagtgggtaaagaaggcgtgatcaccgttgaagaaggcaccggcctgcaggatgagctggatgtggttgaaggtatgcagtttgatcgcggctacctgtcaccttacttcatcaacaagccagaaaccggtgcgattgaactggaatctccgttcatcctgctggctgacaagaaaatctctaacatccgtgaaatgctgccagtgctggaagccgttgcgaaagccggcaaaccactgctgatcatcgcggaagatgttgaaggcgaagcgctggcaacactggtggttaacaccatgcgcggcatcgtgaaagtggctgcggttaaagcaccaggcttcggcgaccgtcgtaaagctatgctgcaggatatcgctatcctgaccggtggtaccgtaatctctgaagagatcggtatggaactggagaaagcggctctggaagatctgggccaggcaaaacgcgttgtgatcaacaaagacaccaccaccatcatcgacggtgtgggtgaagaagcgacaattcagggccgtgtaacccagattcgtcagcagatcgaagaagcaacgtctgactacgacaaagaaaaactgcaggaacgcgtagcgaaactggcaggcggcgtagccgttctgaaagtaggcgcagcaactgaagttgaaatgaaagagaagaaagcccgcgttgaagatgcgctgcacgcaacccgtgctgctgtagaagaaggtgtggttgctggtggtggtgtggcgctggttcgcgtggcagcacagctggttgatctgcgtggtcagaacgaagatcagaacgtcggtatcaaagttgcgctgcgcgcgatggaatctccactgcgtcagatcgtttctaacgccggtgaagagccatctgttgtcgctaacaacgtgaaagcgggcgacggtaactacggttacaacgcgcagactgaagagtacggcaacatgatcgacttcggtatcctggacccaaccaaagtgacccgttctgctctgcagtacgcggcctctgttgcgggtctgatgatcacgaccgaatgtatggtcactgacctgccaaaaggcgacgcacctgatttaggcggcggcgctggcggtatgggtggcatgggcggtatgggcggcatgatgtaattgccgttgactgcttaagtcatcaaagaacccccgatcggaaacggtcgggggtttttcttttttagcgtctgaatgctggcagtagcaggaaaaacccattaactttttttatgttctgcatcatggtttagtcagggcgggatgctctaacgtggatcccggcgcaaaatagcgcgctctgaaagggataaacaacagattaaggaaaattaaaatgcacgataaatgggaattttataaggacgaagcacacaagtggcgctggagaagaacggcgcccaacggaaatattaccggcgccgccagtcagggctacgttaacaaagccgattgcatcgaaaatgcacgacgtaatggctacaccggttaagggcatcacgctctgacatcacccccgatcggaaacggtcgggggtttttcttttgggtgggaaaatagtataagtaagtcgcaatcgttcgtctttcctcttgatatgtcacgctgtctgcggctgcgccgactgatcgactggcttcattttattcaccagcatcggcacgcttgccagcctgcaagcggcgtgaaatattgagacgatataacgggataagggcaatgaatgtgcagaaagaaaaatcctttttctgctacgctgccacccgactctgatgataataaatggggattacaatgcggattaacctcttgctcggactgacggctggcgcgttattgctggcgggctgcagcagctctacgcaactctcttcagcaggacagcgcgtgacgttcaccgatcagcagcctggcaatacctgtcagcttctgggcaatattaccggctctcagagcaactggctgagcggtgcaggcggggaaaccagcgcactgcgtggcgcagcaaacgacctgcgcaatcgcgcagcggatatgggcggtaacgtgatttatggagcaaccagtccaacgcagaacctgttgtccgcgtttcgcgccactcgacagcaaaatgaccggccaggtctacaagtgcccataatgtgaatcaggcagtctgccaaattgaaccggccagccttttactggccgtttttattcctgacgtaactgtaaatctaacggtgttttacttggctctccgccaatttcacgcgccagctttggcaccagatagccggagacctgtgacagtaatgcacgcaccagctggcgggcctcgtcatctgacacaaagaaatgcgccgcaccctgtaccttatccagcacgtgcagatagtagggcagaatgccggcatcaaatagcgcattgctcagggtggccagcgtctgcgcattatcgttgatgccacgcaacaggacgctctgattcagcagggtcactccagcacgcttcaggctgctcatcgcctcacgcagctcatcatcaatctcctgcgcatggttgatgtgcgtcaccatcaccacctgcagatgcgtctcgctgagcatctgacagagctgatcggtaatgcgcgccggtatcaccaccggtaaacggctgtggatgcgcagacgtttcagatgcgggatctgttccagcgcggcgataagccaggcgagctcatgatctttcgccatcagcggatcgccgccggagaaaatgatctcatccagctcgggatgatcggcgatatagtccagtgcagcctgccagctacgcttgttgccgggattatcctgataggggaaatgacggcggaagcagtagcgacagttgacggcgcagccgccttttaccaacaataaagcccggtttcggtatttatgcagcaatccaggtacaacgttgctttgttcatcgagcggatcggtgctataacctggcgcatcagtgaattcctggcggcgggtcagtacctgaagcagcagcgggtcgtgcgcatcgccttttttcatccggcggatgaacgcatgcggtacacgtaaggcgaaaagacgccgcgcatccgcaccttcagccagctcagtgtgctgatcaagggctaaaatccgcagtaattcatcaggttcggtgacaacatccgcaagttgctgcaaccaatcttctctggaaggtgtttttagggttacaatgtgtgccatttttttggcttagtaccagtgtcaattttcgtagagggccttcatggcgacttattctagcaacgatttccgtcccggtcttaaaatcatgttcgaaggcgagccgtatgccatcgaatccagtgagttcgttaaaccgggtaaaggtcaggcattcgcgcgcgttaaaatgcgtcgcctgctgacgggttctcgcgttgagaaaacttttaaatctaccgactccgccgaaggcgctgacgtagtagataccaacctgaactacctgtacaacgacggtgagttctaccacttcatgcatccggaaagctttgagcagttccaggttgaagagaagacggtaagcgatgcagcgaaatggctgcaggataacgctgaatgtatcgttacgctgtggaacggtcgtccgatcgccgttcagccgccgaactttatcgaagctgaagttatcgaaaccgatccaggcctgaaaggtgataccgcagggactggcggcaagccagctaaactctctaccggtgccgtggtgaaagtgccactgtttcgtgcaagagggcgaagtggtgaaagttgacacccgctctggcgaatacgtgtcacgcgtgaaataagattcgcaggcgcatcttctgatgcgcctttttcttgtctgagagaaaaaaatgatcaagctggcaaaattaatcgcgttcgcgttgctggtctcctctgcgttaagcgcctgcaacacattccacggttttggcgaagatgtctctcacttaggtggtgccatttcgcgtgcagcaaaatgaccttaactgattgtcctttttaaagtctcgccagcagcaactgccggaaatccggctatgcttaaagcgctgtactttacatccatcaaaaaggacattgttatgttaaagaaaagtattgctgcaatcttctctgtactggtgctctcttccctgctcacagcttgtaatacaacgcgtggcgtaggtgaagatgtcgaagcgggcggccaggcgattcagaacagcacgaagtaacctgttattccaaccggtacgaaatgcttttcgtaccggcttgtcagattctgcactatttctgttttacccagattaactcttcaaccgggaaaccatcccgacgcgcctgatcaaccagtttctcttttacgcccggttccagttgtggtgtgcgtgacagtatccagagatagtggcgattcggtccacataccagcgcatagcggtagtcaggatcgagagcaatcacgttatagccgccatagaaggggccgaagaaagagactttcagagaagcccgcgtgggttcaccggtaaagtaggctttgccaacgctctcctgccagcgctgctttttgacgttatagccacggttgattaccttcaggccgccatcttcacgcgggctgtagtttgccgttacctgttcaaggccgcgctcaaaagggtggttaaggcgggcaatctcataccactgaccgagatagcgctggctgtcaaagttatctacgaccgtgacgtttctttggcggcgtagtgctgcaggcgacagagagaaaagcactcaggctggcaacaactgttttccatggagacatagtgggattcctttgtgatttaaccgcttaagtatagaagccgaaacgctgtttttggcagtacgggcacgagattgtttgccgcaggcattgcaggtagacttcccccctaatttgtatcaggagtcatcaccatgagcgaaacggcaagctggcaaccaagcgcatccatcgccaatttgttaaaacgcgccgctattttagcagaagtgcgtcgtttctttgccgatcgcggcgtgctggaagtggatacgccggcgatgagccaggccaccattaccgatatccatctggtgccattccagacgcgttttgtcgggcctggcgctgcgcaggggcgcgatctctggctgatgaccagcccggaatatcatatgaaacgcctgctggcggcgggcagtggcccgatctatcagatggcgcgcagcttccgcaacgaagaggcgggacgtcaccacaacccggaattcaccatgctggagtggtaccggccgcattacgatatgtaccgtctgatgaacgaagtcgacgatctgatgcagcaggtgctggagtgtgacagcgctgagtcgctctcctatcagcaggcgtttatccgtcatcttgagctggatccgctgtcagcggataaagcgcagttgcgtgaagcggcagagaaactgggtgaaggcgagctggcgcgtgcagaagaggatcgcgataccttactgatgctgctgtttatgctgggtgtggaaccaaagattggtcaggataaaccctgcttcgtttatcatttcccggccagccaggcagccctggcggagatcagcaccgaagatcaccgcgtggccgaacgctttgaggtctattacaaaggcattgagctggcgaaacggtttccgtgaactgaccgacagccgtgagcagcgtcagcgttttgagcaggataaccgtcgccgtgcggcgcgcggcctgcctgtgcatcctattgatacatatctgctggatgcgctggcgcatggcatgccagcctgttccggggtcgcactgggaattgatcgcctgatcatgctggcgttgaaagcggagtcattgagtgatgtcatcgcgtttccggtggatcgctgctaatcggttaatcacaaacgatggcggattagaggggaagggttggcccggatgaagagcaaagcgtccgagccaggatggcgaggccgaccgccatggatggcggccttctttgcgatcagccgggccatccctgacctggcacaggtttcagctaactactgctgtcaggaaactcctgaatggtgaccggcagcgtcagtttctgatcgtttcgcagtacctgcacatcaatcactgaacccgggcgaatttctgccacctgatccatggtctcctgcgcggagatggccggcttgccattaacgctgagcagcacatcgttggcctgaatcccggctttatccgctggcccatctggtgtgaccacgctgacaataatgccctgaacccgatccagattgctcccctgtccatgcagcggcggcagctcacgcccggtaatgccgatatagccgcggatcacccgaccatcacgaatcagcttatccatgatcttcgaggctaaaacggttggaatggcgaaaccaatcccttccggggtttcaccatcactacttttatcgaaggtcagggtgttaatgcccatcagctcgcctagcgagttaatcagcgcgccgccggagttaccctgattgattgacgcatcggtctgcaggaagttctgtcggcctgatgagcttaagccaacccggcccgtggcgctgataatgccctgcgtgaccgtctgaccgaggttataggggttgccgatagccatcaccacatccccgatatgcgcctggcgatttggattgatggggataacgggcaggccggaggccgtgatcttcagtaccgccagatcggtcataccatcggaacccaccagcgtcgcttcaaagaagcggccatcctgcagcgccacgataatttgatcggcattattgatcacatgcttattggtaaggatgtagccttttgcattcatgatcacccctgaaacccagggtcgtgatgccacgattgttgttgccgtgggcgctacgattgtaaacgttcacaacggcaggcacggcgcggcgcaccccttgattgaagctaaagggcgtttcgtctgtaatattttcgtggttatagagggcgtcgctgcccatacgcagtgcaggcagtgctgcgagcaaaatacccgccacaatcaggcccagcaccacggcacgcaaaagtttaagaaacatggtgttaaattacgccaggggagatcgcaggggagaatagcatgagagcggcggacacacacgtgcttgtgtccgccgtaatgcgaggtttatctcaacaacagatagatactttcatcgccgcgcaccacattcagtgccagtaccggcggtttcccttccagtattttacgcatttcagcaatggtctgaacccggttgcggttaacgccgataatcacatcatctttctgcagaccaacctgttcagccggtgtgcctttttcgatggtatcgaccttcacgcctttatcaccggttttagtctgtccatcactcagggttgcgccctgaagcgcgggtgacatcagctgtgcgctggcggtgctctgtgcgctctgctccagcgtaacggtaaccgttaatggcttaccttcacgcagcaggccaagtttaacctgttcacctggcggcgtggttcccactttgacgcgcaactcagcgaagctggtaatcggcttgtcgttgatcgacgtaatgatatcgcctgacttcacgcccgctttctgcgcggcagattgcggtaagacttcagagacaaaggcgccgcgctgcgcatcgacattgaatgctttagccatatcggctgtcatttcagtgcctttgatgccgagctgaccgcgcttcacttcaccaaatttaatcagctgctgcgcgaggttcatcgccatatcactcgggatagcaaagccgataccgatgttaccgccgctggaggcgagaatcgcagtgttgataccgatcagttcgccgttaaggttgaccagcgcaccgcctgagttgccacggttgatcgcggcatcggtctgaataaagttttccagtccttccaggttcaggccgctgcggcccagtgcggagataataccggaggtggccgtctgtcccagcccgaacgggttaccgatcgccaccgcgaaatcacccactttcagctggtcagagtccgcgacttttacctgcgtgaggttttttgcgccctgaatctgaatcagcgcgatatcggtctgctcatcatggccaatcagtttggcttcatattcactgccgtcgccaagctgtacgttgattttatccgcaccgttgactacgtgattgttggtgagcacgtagcctttcgcggcatcgatgatcacgccagaacctaaaccttcaaacggctgtggctgactatttccgccaggcatctgaccaaaaaaacgcttcagcggttcaggaatatcctgagcctgtgcacccgaatcagtgccttccacgtgcacactgaccacggcaggtaacactttctccagcatcggtgccagactcggcagcggctggcccgcaatttgtgctggcagcgttgccatcgcgtctggcgcggcggcaaggctcatcccaatactcagggctaatgcgctaaacaggcgtgcttgttttttcattgctacaacgctctcgctgcaaaaggtgggaggaattaataagtgtgacagtcgtttgcggtcagggttcgcaaaaacagcgggcgcagacaggctgcgccccaaaaagattagtcgcgggcagggcgctcgccacgcagtaaaccggatgcgccttcagaatagtcgcgcggcatctgcaccggcacctgatcgttgtccgcttcggcttcagtcagctgataggcaaacggatttttctggccaggcagattcggcagcaggtcatttgagccttttgccatgtgctgatagagctgacgataatcacgcgccatgttgtccagcagctccgcgctctgcgcgaagtggttggtcagctcttcgcgataatccgccagctccgctttcgatttttccagctcgtactgcatgctgcgctgctcacgcagctttttgttgccaaaacgcatggcgactgcgccgacaataataccaaccactaaaccaattagcccgtattcccaggtcataatgactcccgtgttatttccattgttccgtagggcattgcaccatttcaataatagtcactatacccgttaatcttatggatgtggaactctggagcagcatggcttagtgtagaacggcctttttttcagcaaccgtggtatgaatcagacaccattcagggactttgaaacaacaatgcaaacctcaactccgcttgcacgctatgaacaggcgctgtcgcagggcgaattcaggcccgatgacgtacaacgtgaagcgattacccgtttagacgcgctgcagcaggcgctggttgcccggcaacaatccgccgcgcctgccacatccggcctgctgggccgcctgtcaaaattgatcggtaaagagaaaaacgagacgccacaaccggtacgtggactctatatgtggggcggtgtcggtcgcggtaagacctgggtcatggatctcttttttcagtctattcctggcgatcgcaaactgcgtctgcacttccaccgctttatgctgcgggtgcatgaagagctgacgcagcttcaggggcagagcgatccgttactgattattgcggacagattcaaagcggaaacggacatcctctgttttgatgaattttttgtctccgatatcacagatgcgatgctgctgggcacgctgatggaagcgctgtttgaacgcggtattgcgctggtggccacctcgaacattccgcctgatgatctctatcgtaatggtctgcagcgcgcgcgcttcctgcctgccatcgagcagatcaaacgtcattgtgatgtgatgaatgtggatgccggtatcgactaccggttacgcacgctgacctccgcgcacctgtggaactctccgctgaacaaagagacgcacgctgaaatggcgcggatgtttaaagcgctgtcgggcagccagcctgaagatgcgccggttctggaaattaatcaccgccagatgccgacgctgggcgtcagcgagggcgtgctggcgattaatttcaccaccctgtgtggcgaagggcgcagccagcatgactatattgcgctgtcgcgccgttttcacagtgtgctgctgtatgacgtgccggtaatgatctacaaaaccgaagatcaggcacggcgtttcctggcactggtcgatgagttctatgaacggcatgtgaagctggtggtcgcggcagaaacgtcactgaccgagatttatcagggcacgcggctgaagtttgaataccagcgctgtttatcccgacttcaggagatgcagagcgaagagtatctgcgtttaccgcacctgccgtgagaataatcgggataaataccgaaatagggttcgatttttgtaaccgacttctctataatcttgcgaccccacgttacagcaaaggatttttttcccaaatcctctgtgttccagtaactctatccgaaggggtggcttgctggtcaaaatggtcgtgtgagcctcattcgtttacttaagcgtttgggatttcaccaacgtgtaacttaatttgggtaagcttttcgatgaaaacttttacagctaaaccagaaaccgtccaacgtgactggtttgtagttgacgcaacgggcaaaactttgggtcgcctggcgactgaactggcgcgccgtctgcgtggtaagcataaagcggaatacactccgcacgttgatacgggtgattacatcatcgttctgaacgcagaaaaagttgctgtaaccggcaacaagcgtactgacaagatctactatcaccacactggccacatcggtggtatcaaacaggcgacctttgaagagatgattgctcgccgtcctgagcgtgtgattgagatcgcggttaaaggcatgctgccgaagggcccgctgggtcgtgctatgtaccgtaaactgaaagtttacgcaggcaacgagcacacccatgcggcacagcaaccgcaagttcttgacatttaatcgggattaaaggcaatggctgaaactcaaaactacggcactggtcgccgcaaaagctctaccgctcgcgtattcattaagccgggtagcggtaacatcgtaattaaccaacgttctctggaacagtacttcggtcgcgaaactgcccgcatggtagttcgtcagccgcttgagctgctggacctggttggtaaattcgatctctatgtcactgttaaaggtggcggtatttctggtcaggctggtgcgatccgtcacggtatcacccgcgctctgatggaatacgacgaatcactgcgtggcgagctgcgtaaagctggcttcgtaacgcgtgatgcgcgtcaggttgaacgtaagaaagtcggcctgcgtaaagcacgtcgtcgtcctcagttctccaagcgttaattgtttgcagctccggctgcggcaattggctcaaaaaacccgcttcggcgggttttttattttctgccttcccataaactgtccgcgaaaaccgtaacgccgcgctcaatttacctgcaaagattcattccacgcccacaagcagcctaaaatctggtaaactctgtgtcactttgcgcccgcaggccggtgcgttatgcgcctccccactgtcggggcgtcagtatctgtgacgcagctaaccaggttgcgtgcgagttcgataagcaagtgagtcgccgtgtggttggctattcgcagtatctttttgtgaacaaacttggaggttttcatggctgtcgctgccaacaaacgttcggtaatgacgctgttttctggtcctactgacattttcagccatcaggtacgtatcgtcctggcggagaagggtgtcagcgtagagatcgagcaggtcgaaatggataacctgccgcaggatctgattgacctcaatccgtatcgcacggtaccgacgctggtagatcgtgagctgacgctgtatgaatcacgcatcatcatggaatatttagatgagcgcttcccgcatccgccactgatgccggtttatccggttgcccgtggtgatagccgcctgatgatgcaccgcatcgagcaggactggtatagcctgatgaggaaagtagagaacagcagcggtcaggaagcggaagcggcacgcaagcaactgcgtgaagagctgctggctatcgcgccactgtttggccgtacgccttatttcatgagcgaagagttcagcctggttgattgctatctggctccgctgttatggcgtctgccgtcaatgggtattgatttgatcggctcaggttcaaaagagctgaaaggttacatgaatcgcgtatttgagcgtgactccttcctcgcttcattaactgaagctgaacgtgaaatgcggctgcaagcccgggcttaacgtatggaaatgtcgcaacttactgcacgtcgtccctatctgctgcgcgccttttatgactggttgctcgacaaccagctgacgccgcatctggtggtcgacataaatctgccgggtgtgcaggtgccgctggagtatgcgcgcgatggtcagattgtcctgaacattgcgccacgtgctgtcggtaacctcgatctggcgaatgatcaggtgtcgttcaacgcccgctttggtggcgtttcctcgccaggttaacgtgccgatggcggcgattctggcaatctatgcgcgtgaaaacggtgccgggacgatgtttgaaccggaaccggcttacgagctgggcacgcatgaggcgtcagagggtcaggaagagactatgatgtcggtgattgatggtgatcgtcctgacgatgccagcgatgacgatacaccgcctgatgacgatccaccgccacgtggtggacgaccttcactgcgcgtagtgaaatagcagtgacataacagcgaatacccgtccatccgacgggtatttttttgcctgtcagccataaaaaaaatccggctgcctgcgcaagccggattttttcagcagaccatcgcgatcaatagacgtcgcgcaggtagcgcttctctttcttcagctgatcgacatagtcagcagcgcgctcggtggagaggccaccaaactggcgaaccacttcatacagcgcattatccacatccttcgccatacgcgatgcatcgccacagacatagaagtaagccccttcctgcagccaggcatacaactcagcgccctgttcaagcatccggctctgcacgtagatcttcttctcctgatcgcgtgagaacgccagatccagacgcgtcagcaagccattatcgcgccaggcaagtaattcatcctgatagataaagtcatgttcctgatgctgatcgccgaagaacagccagtttttcccctgcgcaccggttgcctggcgctcctgcaggaaggcacggaatggcgcgataccggtacctggccccaccatgatcagcggtgcgctgttgttggcaggcacgcggaacgatttattgggtgagataaagatggcgggcttctcaccgcgacgcacacgctcggccagataggtcgagcagacgccaccgcgattacggccgccactgtgataacgcaccgaggcaacggtcagatgcacctggtcaggatgggctttagagctggatgaaatggagtaagcgcgatgctgcagcggacgcagtagcgcgacaaactcgggtaccgccagcgtgcgcgtcagctcaagctgcagcaggtcaagggtatctttaccccacagccacacgcccagcgcatctttatcatcatgctgtaacacatgacgcagctcctggttggtggtgttctgcccgacccattcgattaacttgcgtgacggctctgagatctcaaactgataggtcagcaggtcgccaaggctgcgatcaaagccgggcaccggcgtctcgtagtccgcgttaagctgggtcagcagcaggctgaccagcgacggctcgttgaccggaattacgcccagcgcatcgcccgcttcatacttcaggccgctgtcagacaggtcgaactcgaaatgacgaatatctttagctgagtgctcgcctgacaaacgcttgttggtgatcagcgcggcggcgtatggattggatttgttgctgcctggaatgactggcgcttcaggcgcgctttccagcacggtgccgctgctgcccgcgctggcggcaaactgtggcattgagctgtttagccactcgctggaaggctcctcaaaatcaatatcacaatcgatacgatcaaccacgcgtttcgcgcccaactgctcaaggcgcatatcaataaacttgcccgcctgacagaagccatcgtagccggtatcgccaatcgccagcacggcgaaatgcatctgctccagacgcggtgcggtactggcagagatcgcatcccagaacagctgcgcgttgtccggcatttcaccttcgccataggtcgaggtgacgatcagtacatggcgcatggtggcaaatacgtcgagatcgacatcgcccagcgcctgaaccactggcaccagacctttagcgcgggcagatttcgctgcggtctgcgccagtgcttcagcattgccggtctgtgagccataaagaatgtgcagttgcgtcgtcgcggctgcgcttgtgcccgcggcgggttgctgcttgtcttctaataccagcagacgggagtgcagacccgcaagaaagccagccagccagtacttctgatcgccattaaaaggtgcatcttctggaatataaggaattttcatgggtacttttactcaatcccgttctcgcccgtcatcagtggcattgtccggtgtgaaagcggttccgctttcccgcgccgcagcgtgtgcgacaggggagagcggtgctgcatctgtccggtacaacgattaatccgggcaatgatcaattaataatattcagttcagcctgatcagtatcactgtcaggagagtttacccaccgcagcggcgatttccggcaatgccgcacgtgcaaacagctcttcaaagtcaggcaggtggcccagcacttcccggttacaggcatcctgatacatgatccagccgtaggttgccagactgtccatggagcggatgttacgttgcgtcagcgccgctttgtaatctgacatgcgtttggtaccaatcagactcgccagttcatcatcgctgtagctctcgatggcggaacgggcatgacgctgcagcttgcttatcagcgaaaagtcttccgtcatcaacagattacggaccgctttttcaactgccgcatcttcaaccggggtgcctttcggtaatttgcccagcgccagctgctgggcaaagctcagcacggtgtagttgttgagcaggacaaacatctccagcgtatcggtcgcgccataagccggtacggcaccgttggcgatggttttaccctgacgccatgcggctttaaacttcgccacctgatggcctgccagcgccgtcgacagctcttcgagcagatctttgcggctcttggctttcagaatctcgccgccatcctgatagagcagcagcgagcgcggcatcacgtaaacaaagtggtgacactccgtttcccagttctccagcagccaggcggcacgcggtgatttggtcgcctccagatgccagttcagcatggtcagcaccgcctgcttgtgcacctgggccatctcatcctgatcggcaatcgagccgaactgtaccgaatcaccggcagcatggctggccagcgatccataggggtcgtactggtaggcgaagccgccgctcatgccgttgccaaatcctttaccgaaggtgcccaggttgaggatggcgccattggtcatatattcgcagcagaagtcaccgacgccttcaaccacggcggtggcaccggagttacgcaccgcgaaacggtcaccggcctggccctgcacgaacagacgtccgcctgtcgcgccaaacagcgcaaagttaccaatcagcacgttgccatcggcatcctgcgcgccgccaccaggcgacatcacgatcagttcgccgccacactgtcctttgccgacaccgtcgttacaggtgccgtaatgggtcagctgcatgccatcgttgcagaaggcgccaaacgactgaccggcagaaccggtggtggaaatttttacgctctcaggggccagatagcgacgaccgcgatcgtcagtcattacggcaggcatcgcctgcagctgctcagaactcagctgatggttcagcatccgctcaatatcgatggccagctggccgccgacacttttgtttcggttattcagcacgatgttgttgcccagagtgacgtcaggatttccctgatccaccagcgacagcttcagttgctcaatccagacatcatccagctcaaaatctttttccagataaaccggcttgtcgattttcagctcaggcaccacggtaagcatggcgcgtaagtcgagcttgcccacttccagcgggtgatccatcaggtgcaacaggtcagagcgaccgcgtgcctcacgcagggaaacgcaggcccatacgcgccaggatttcacgcacttcatgcgccacgttgaggaaatactgcgccagctgacgtggatcgccatcaaacgcttcggcattcgtggttaagccagccgggcacttaacgttacagttcttcgccatcacgcatttcagcatcatcagcgccgtcgtaccgaactcaaagctgtcgccgcccagcagcgcagatttcaccacgtcgctgccggtctgctgtgcgccagagcagcgcagcagcactttctcacgcaggccgttggcgcacagcgcctggtggacttcagcgatgccgatttcagccacgcgtccggtatatttcaggctggtcaccgacgcagcgccggtaccgccggtgttacccgcaacgttaatcacgtctgcacccgctttggccacgccgaccgcgatggtgccgatcccttcagacgagaccagcttgacgataacccgcacccgcgcggctttgcagtcgtggatcaactgcgccagatcttcgatggaataggtgtcgtgatgcggcggcggtgagaccagctcgacgccaggcgtaccgccacgcgcggcagcaatctcgacggtaactttggccgccggtagctggccgccttcgccaggtttcgcaccctgaccaattttgatctccagctcttccagcatcggatctgccagataggcagcccagacgccaaaacgacccgaagccagctgtttgatgcgtgaggcacgaatggtgccgtgacgggagtaatgctcgccgccttcaccgcagttactcatgccgccgaccatattggtgccgtgcgcgaccgcttcatgagcgggagccaccagcgcaccgtggctcatcgccccggaggcaaaggtacgggtaatttcacaggctggctgcacttcgctcagcggcagtgagggcagggtggtgaagatacgtgacagataatcggccgctttaccgtaagcggtcactttcagaccgccagtcaccacttcgctgctttcgatatcgtcaccgaagcgggatttcagggcgcgagacaggttctgcaggcgttcgctctcaggcttcagtccttcaatcgcatcggtcagacgcagcataaagtgattcaggctgccatctaccgcttcacactccatgccacgaatggcaaagccattgttggtcagcgagtagcgtcccagcttgcggcggaactccgcttcgctgtcgatgtgggtcaggtcagccgggaatgtcaggatgtcgcgcagggccgccgggcgacgtttacgctcttcatacatcaggcttgagaactgacggtaatcagcagtaatcgcgaaattattaatcacctcatccgggatgcgctcaaagctgctgtctttaaaggtctctggcttgatgccaaacgcattatccagtttagccagcgtcatcaggcggatgaagttgtcctcttcgcgcgctttgtcggcaaagcgaatcggctcttcggtcatatcgataaaggtccgcacggcgatggtgccgtaggagtgacctgcgccttctgcacgctctttgaacaggcccagcaacggaacttcagattcgccctgaatcttcagtgcactctggtgccagtcaacggccatctgcgcgatcgtcgcgaagcctgcgccgcccaccggcgttttgatattcgggaaatactttttcagcaccggatcatcggtgttgaggaagttaggctcaaagaactcgccgctgctgtagctctcaacggtacagaggcccactttgcccatggttttcatcagtgctttttcagccgctttggcatagcgcttaaaggctttgttaccttcttcaccttcaccaaatttctcctctgcgcgcatctgtacgcccagcggatagatagctgacgccccaaagccaagtgtggcggcaatgtggtgcgacgagatgctctggccgctttcaaccaccagagaaacatccagacgcaacccttcctttatcaggcgctggttgatggcggaaaccaccagcagcatcgggatcgcggcgtgctttgaagagatatggcgatcggtaagtacggcgatgccaccctgggtacgggcaaaatcaaccacctgttgcgccaggtcatcaatcgccttttccagggcattcgcgttcgcggtggtgctcagcagatctttgccgatcaccggctcatagagcatctcaaagcgggcataaggtgcgatggtctgctcgcgtaaacgcagcatatcgaggtggctgagaatcggggtcggcaccacaatctgacggcctttgctgcggcccagatggggttttgcccccagcgcgacacgcaacgtcatgccatccacttcgcggattgagtccagcggcgggttggtgacctgcgcaaagcgctgagagaagtagtgcgccataccgccttcatgatcggataagccgttgatggcgttgccgtaacccatcgcggagatcttctctgcgccggtattcagcatcggatccatcatgaacttgaagctttcctggttgtagtagtaggcaacaaagcgctgatacgttttcagatcgccacgataacgcagcggtgaaccctgttgttctgccgggatctcgggcagatcgtcaagaccgacgcgcgcttcacgcagcaacgccgaataatctttctctgcggccagtttttccagcgcctgcagcgtggtatagctgcgtttttcacggtgatcgaaatagagcataccgcccgcttcgatacggccacgacgcaacacgctttcaggtgggaaggcgatctggcccgcttccgacatcgcaccgatatagtcagcggtttctactgaacgcagtggacgcagacccagacgatcaagacgggcgccaatcacttcgccattaccaaagattaaggcagcagggccgtcgttcttctcttcatacagcgagaagtactccagcatgtcacgcacttctggcgacagcgcgctgtcgttttcccaggcgggcggcatcattgacaccacggcggtgatcagatcgaggtcatcttccatcagacggctgtggatgctctgatccaggcgcgaactgtcggactggcctttaggccgcacgatggtcttgccacgggccagtgccagcgcggactcagcgatgcggtttttacggtcagtgttcagctcgccgttgtgcgccatcaggcggaacggctgcgccatcgtggtatggggatcggtgttagtggagaagcgggtgtggaaaaacaacccgcgcacctgatgatcgggatcggtcagatctttgaagtaagggatcacttcattggaattcagacgggctttgaacacctgcgtgcgtgaagacagcgacagcggatagagaccgccaaattcgctttcggtgaaagctcgggcttcaatggttaacagggcgcggtagatgcgtttttcgaagtcgttctgatccaccacatcctgtggcgcagtgaaaatccactgcagaatcggtaactggaactgcgcggctgccgggcgcgtcacgctgctgtcgagcggcatgtcacgcttcataagtaccggcagaccaaagctgctgagggtttcatccaccagacgttcggcattcgcgcgcagctcagcatctttcggcacaaagaagttaccgacaccaaagcgtcccgcttccagcggctggccggtaattttgcggaagaattgcagcgaaagatcaacgttgacccccgcgccgtcgccaacgccttccgctgacatgccgccgcggtgaggcaccgtacacagggcgctgtgcgccatctgcagaatctcgtgggtctgctcgccgtccttacgcgtaatgaaacctacaccacagctgtcactgcctgctgtcggatcatacaagccataggattgaggttttttagtggacattgagggtctccttaaactgctttgacattacctgcactgtttcagggtctgagcgcaacgggggcgctatcattttcatcgccatgctctgtcgagcgcgcgtcatagccctgagcatttctctccagacatcggtaaaacgtccttaattgagctgctctctgatttccggtctcttaaaggagatgacttaaaccacgcgggagtcttcttgttgcatagatatgccgagacaatggcccgtctggaaagctttcagcggatttccaacttatcgggaaagcgtaatcaggtcaaatagggcggtcagacgggattatcatgcgttttatctgcttaagtctatgaattaaatgctttttaaggtttaaaatgtatcactctggtgcctggcgacaggccgataaatgtgaactgactcactgtagtgcaggcgtcagatctctgcaccatgctggtgacagggtgttaagcagcattaaatgctgttcagcacccatgatgcatagcatgtatctgtttttcttatgtccggttatttgaatgaaaccgcggttggttataagaaaaattaatcagcatgggcatgcttaaaacagcattaaagatgaatggctatgcatataaaagggtgtgcctgtgcaacaggacgctgccaggatattgaaaaaaggccgtacagagaaatcggttattcgctggcggccttacagattattcatttggcacagtcagtcaagggttttaaccgctttgtccttaacgtcgccgatcggcgaggctgctgcaccataaaagcgcatttgatcccttatctccacgcgacgtgctgcgacggcagcgggttaactgcgctattatgaggctgtttctcttccagggagttgttatgaaacaaattcgtctgttggcgcagtactacgttgatttaatggtgaagcttggactggtgaggttctcgctgctgctggcgtctgcgctggtggtgctggcgatgattgtccagatggcggtcacgatggtactgcggggccatgtcgagagcattgacgtggtgcgttcggtcttcttcgggctgctgatcacgccctgggcggtctattttctctcggtggtggtcgatcagctggaggagtcacggcaacgactggcacggctggtggataagctggaagagatgcgtacccgcgatctggaactcaatcagcagatgaaagagaccattacgcagctgaatcaggagatcagcgatcgtaaaaaggcggagctggcacgcgaacaggtgatggataagctgcgtgaagaggtaacgcgtcgtgagcaggcacagattgagctggaacagcaatcctccttcctgcgctccttcctggatgcctcgcctgacctggtgttctatcgcaacatcgataaacagttttctccggctgcaaccgtgcaatggagctgctgaccggcaaaagcgaaaagcagctgattggcctgacgccgcgcgatatctatgatgatgaagcggccactaaggtgctggaaacggacgagaaggtattccgccacaacgtctcgctgacctatgaacagtggttgcaatatcccgacggacgcaaagcctgcttcgagatccgtaaagtgccttactacgaccgtgtgggtaagcgcagcggattgatgggctttggccgcgatataaccgaacgtaagcgctatcaggacgcgttagagaacgccagccgggagaagaccacctttatctctacgatcagccacgagcttcgtacgccgcttaatggcattgtcggcctgagccgcatcctgctggacaccgaccttaatcaggaacagctgaaatatctcaaaaccatccacgtctccgccatcacgctgggcaatatcttcaatgatgtgattgaggtggacaaaatcgagcgccgtaaagtacagctggataatcagccgctcgacttcaccggtttcctggccgatttagaaaacctctctggcctgctggcacagccgaaagggctgaagtttgtgctcgcgccgcaactgccgctgccgcatatgatctcgaccgatggaacgcgtctgcgccagattctgtggaacctgattggtaacgccgtgaagttcacccagcagggcgagatcgtggtgcgggtaacctatgagcaggacgagacgctgcgctttgaggtgcaggactccggcatgggtatccgtcaggaggagcaggacaagatcttcgctatgtattatcaggtcaaagatcagcatggcggtaaaccggctaccggtaccggcatcgggctggcggtatcacgccgcctggcgcaggcgatgggcggtgatatccgggtgcacagtgcgccgggacagggttcctgcttcaccgtagagattaaagcgccacgcattgctgaagaggtggaggatgaaggcgtggacgacagcctgccactgcctgcgctgcacgtgctgctggttgaagatattgagctcaatgtgattgtcgcgcgctcggtactggagaagctgggctgcagtgtagaggtcgccatgaccggcagcgaggcgctggcgatgtttgacccgctggagtttgacctggtgctgctggacattcaactgcccgatatgaccgggctggatgtctcacgtgcgattcgccagcagtaccagggaacgcatctgcccccgctggttgctcttaccgccaatgtcctcaaagacaaaaaagagtacttcgacgcgggaatggatgacgtgctcagcaaaccgctggcagtgccggcactcactgcgatgattaaaaagtactgggattatcaggcagaaccggaagaggagatcgctgatgtcagcgatgacaaaacccggatgctgctggatgtcgcgatgctcgaacagtatatcgagctggttggtcccagcctgattacccaaagcctgacgatgtttgaaaagatgatgccggactaccttgcggtgctggagtcgaatcttatggcgcgcgatcagaaaggcattgctgaagagggacacaaaatcaaaggggcggcgggtttcggtcgggctgcagcgtttgcagatgctggcgaaacagattcagagtccggagttaccggcgtggtgggacaatgtaggtgaatggattgatgagctgaagcatgaatggcgacacgatgtgcaggtattacgcgactgggtggcagagcaggataagtgataccccggaaaaaaatgaccccagccgaggccggggtgcgcgaaatactgcgccaacaccagggaaatcattgcggccgctatgatttgaataattaatgcagccgcagggtattggttaacactgtcatcaccttagcaaattcatcttctcatgcgacaagattcattaaaatttgtgatattgagcagcgtttaaatacagaaaacattaatttggcaacacagtcaagtaaggaattaatttctgtgctgtgttgctgctattttaatcagttttacgctttttcgtgtagttttaatgctgccgggcagggaaactgaggctgagcagcaccaaagtgagccgccgttaacatttgccttttgagtgaggctaacgcgctgatattgcaagcgcgctgcctgaaatgacacgaattatccaaaacgatttggaatgataaaaaagaatctaaaagtttgtccttctgtcgttctgctatcagggttattcctggaaggaaatagtgccattctggcaacccgtgacgctattaagcgctgcttatttatccgttataacgataattctgattaacctttaggcgcggcaggattaagaaaacaataacagttaagcatgataaatgattcatgcgggcgcttattactcatgattaagtgtttatctggaaagatgctaagcaatggcaatgaatggaaccgattccttttttgcggaagtacttgaactatttcgaactgttgcagcatgttgatgcaaaatgattgaataaagtctggaaacagcctgtcagttttcagcgataatcgtaaaaaggctgcttttttagcagtgattacatgagtgattgattaacgtctgaaacaagtgtgggaagattgcatgaacaagcataaaggaagcgtcggacagcgtatcagacgtattgttggtcgtatcgtactggtgtggctgggaatatggctggcgggcattttactcttttcgttcttacccgtgccgttctcagcggtgatggctgaacgacagatcggagcctggttacgcggtgattttagttatgtcgcccattcagactgggtcggccatgacgagatttcgccctggatggggctggccgttatcgcctcagaagatcaaaagtttcccacccattggggctttgatgtggcagcgattgagtccgtactggataacagcgatagccggatgcgtggggcgtccacgctgtctcaacagacggcgaagaatctgttcctctgggatggtcgcagctgggtgcgtaaaggtctggaagcgggtctgacggtaggaattgaaacggtctggacgaagcggcgtattttaaccgtctatctcaatattgcggagttcgggccgggcatctttggcgttgaggcggcttctcagcgttatttccataagcctgccagccggctgaccgcagcagatgctgccttactggcagcggtgctgcctaatccgatacgttatcgtgctgcagcaccctcaggctacgtcagagagcggcagcagtggatactgcgtcagatgcgccagcttggcggggaaggcttcctgcagcgtaatcagctcgactaagcattaatcttcatcgaaacccgcttcaaataactcaatgaccgctgccagcgccgggatctcctccgggccgctggcttcaatctcaatgtggccgccttttgccgagtcgagcatcagcagcgcaatcacgctgctggcttcggcttcagtgcccgcttcattacgcagtaatacttcggcatcaaagctctgcaccagctcaaataacttcatcgccggacgtgcatgcatgcccagcttatttttgatttctacagtttgtctgacggtcatgatttgcgcttttccagcgtacgatggcgtgactgcacattcttaccccgtgaacggaagtaatctgccagctgttctgcaatatagactgagcggtgtttaccgccggtgcagccaatcgccacggtaagatagctacggttattggtctccagcatcggcagccagagttcaaggtagctgcgcgtctggtagataaaattatgcacttcagtgtggcgatcaaggaaggccgccacaggacgatcgaggccggtcatcgggcgcagtttgggatcccagtgggggttgggcagaaagcgcacgtcaaatacatagtcagcgtcaatcggaatgccatgcttgaagccaaacgactcaaacaccatggtcagctcacgttcacgcttgcccagcaggcgggtacgcagcatctctgccagctcatgcaccgacatctctgaggtgtcgatgatcagatcggcacgtgaacgaagtggctccagcagatcgctctcttcatcaatcgcgctctccagcgagaggtttttgctggagaggggatgcagacggcgcgtatcgctgtaacgacgaatcagggtgttgcgatcggcgtcgagaaacagcagctgaggggaaaatgtatcaggcagattattcagtgcggtttcaaaaatttccggggattcgggcatattacgcacgtcgatgctgaccgccgccgaaatattgcgctcagccagcgagttagctaactcaggcagcagcacgaccggcaggttatcaacgcagtagaaccccatatcttccagcgcacggagcgccactgacttccccgagcctgaacgaccgctaacgatcatcagcaccatgaccttctctcccgttttaaaaccggcaccgggccggtaaagacgcgttactgctccgactggacttccgtaataatggcatagagctcttcatcactctgcgctgcgcgcagacgacggcaaaccgttttatctgccagacgctttgccaccagtgacagggtgtgcagatgtgttttgcactggtcagccgggaccagtaaggcaaacaacagatcgaccggctggttgtcgacggcatcaaacgcaatcggctgttcgaggctgataaacaccccaaccgcgcgcagcgtatcctcttccagcttgccgtgcgggatggctatcccgttaccaataccggtactgcccatgcgtttcgcgggtcaggatcgcttcgaaaagcgtctggtgcggcaggttgagctgcttagcggccagttcgctgatgatttccagcgcacgttttttgctctggcagtggacgccgctgcgggtgcagtctggcgaaagcactgtgctcaattccagtgtgagatcgttgttcattatcgtttcacttgcgtgttcaccaggccattcaccgccagcgcgtattgacgcgtgtgacaaacggcgcctgctcagatgacaaaacggggcggattatccgccccatcctgtcggctctgcgcgccaggcgcgcgtcgctagcgtgaaggttagtgttttttcagtttatctttgtgtttggtcagctgacgggtgagcttatcgatcagtccgtcaatggccgcatacatatcttccgcttcggatgtggcgtgcagctcgccaccattcacgtgtagtgttgcgtcagccacctgcgtgactttctcaaccttcaggacaatatagacctgattgatatgttcaaaatagtgttccagtttggcaaatttaccgttgacgaattcacgcagaggtggagtgatttcaacgtgttgcccggtcaggttcagctgcataggtcttccttctcatttctttcaaaccagttgtttacgctggttcgatggcgggatggataaagactcacgatatttggcgacggtacgccgtgccaccatgatcccctgatcagataacatggaggtcagtttactgtcgctcaagggtttggctggattttccgccgaaattaattttttcaccagggcacgaatcgcggtagaggaggcttcaccgccaccttccgtattaacgtgactggagaaaaagtacttcagttcaaaaatgccacgcgggctgtgcagatacttctgcgtggtaacgcgggagatggtcgattcgtgcatctcaacggcctgggcgatatccgccagcaccatcgggcgcataaattcttcaccctgctcgaaaaaggcctgctgttgctcaacaatacagcgcgtcactttcagcagggtatcattgcggctttccaggctcttaatcagccagcgggcttcctgcagattactgcgaatgaactggctgtcgctgtcgttccgcgtcgcgccgctcattgccgcatagtgctgattgatcttcagacgtggcacgctatcggcattgagttcaaccgtccagcggctgccgatcttacgcaccagcacatcgggaatgacatattctggttcgccggtgttgatcgactgacccggacgcgggtccagcgactgaatcagcagcatcgcctctttcagcacctcttctttgaggcgtgtgacccgcatcaggctgcggaagtcgtggtttgccagcagatcgagatgttcgctgacgatcagacgcgcctctgccagcatcggcgtttcgggcgcatattgtgaaagctgcaccagcaggcagtcacgcaggtcgcgcgcgccaacaccaatcgggtcaaagcgctggatgcgtttcagcaccgcttcaacttcatccgcttcgagctcatcatcgccgatgctgtcaaggatctcctcaagcgaaacggtgagatacccggtgtcatcaatagcatcgacaatagaggtggcaatggcgcgatcggtatcgctgaaacggcgtcaggccgacctgccacatcagataatcctgcagcgactgggttgtttcgccctgataaaccggtaactcatcatcctggtaatcggtgccggtgccggaaggcgtacccgcggtgtagatctcatcccaggtcgcatccagcggcagttcatcaggcatctctttctgctcaagcgcttcgcgtgtatccagcgcctcggcctctgaagactcccgtgaatcgatctcttcatgcaggtcagtctgctcaagcagcggattactttccagcgcaagctgaagctcctgctggagttcaagcgtagagagttgcagcaggcgaatcgcctgttgcaattgcggagtcattgccagctgttggctgaacctgagttgtaaaccttgcttcatagacaggatgatcgttcccaggtaaacatcggtattaacgacaccttatcagagtctgaactcttcacccaaataaacccgcttaacctgctcatccgcaagaatttcattcggtgtgccgtgtgcgatcaggtgcccctggctgacgatataagcccgctcacagaccgctaacgtttcgcgtacgttatggtcggtaatcagcacaccgaggccgctgtcacgcagatgctcaatgatcttcttaatgtcgataacggagatggggtcaacaccggcaaaaggttcatccagcaggataaatttaggattagccgccagcgcccgcgcaatctcaacacgacgtcgctcaccacccgaaagtgcctggcccatgctgtcgcgcaggtgctcaatgtgaaactcttccatcagctcacgggcacgatcctggcgttgctcttcggtcagatcgtcacggatctgcaagaccgccatcaggttatcgtagacgctgaggcgacggaagatcgatgcctcctgcggcagatagccgatgccacgacgcgcacgggcatgcagcggcaggatgctgatatcttcatcatcaataataatgcggccagcgtcacgcggcacaatgcccactaccatgtaaaaggtggtggttttaccggcaccgttcgggcccagcaggccgacaatctcgccggattttacctgcaggctgacatcttctaccacgcgacggcctttatatgccttcgccaggttttctgcgattaatgtggccatagctatcagttactcttctttccgctgttggacgaacctttgtcctgaagttgcgacggcaccagtacagtcgtgacgcgcttgttctggccctgactgaaagcctgcattttctgctctttcaccaggtaggtaatacgatcgcctttgatgttgctgtcctgctgctcaatgaacgcattgccggtcagttcaacgaaatcgttagccagttcatagtgcagttttgcggcatggccctgcaccggcttaccgctgtcctgcatctgatagaaggtggcgggattaccgtaggcgtcaacgatggttttcttgctgtcgccgcccggacgggtcaccacgactttatctgccgtgattttaattgagccctgcgtcacgatgacattgccggtaaaggtcgcgacattgccttgcaaatccagcgcctgattctgcgagtcaatattgacgggcttgtccgagtcaccggtcagagccagcgccggaacgctggttgccagcagcatgctggccagtaaaagcttcaggctatttttgttcattttgaatttcataagaggttttgaccttctcgattaactcggcgttttttgtccgtaaattgccgcgcattttcatgccggtggagttaaaactgcggccatacaatgtcacctggtcatcagaggtaacgtcctgagtgacaagattaatctgggcgttatcggttttgatccgctcaagctgagaatcctgcgtcagcgtattcagctcaacatggccatacaggtaaagcatacgatctttggtgagctttgctttatccgcgcgtaacgtccaggtagggattttgttctcatcaaaggtggtcatgaccggattgtcgaaccagctcagttcatcatccgagaaataggtcactttgtcagagaccagtttatatgacagcgcgccctgcgggttataaaccacagtgtgtgaatcagcactggtgtaggtcggtgactgactgtccgtgccgactggcgtgccatcgtcatcctggttagtaagattccagccgatcaaaaccagtgcaatcaaggtcagaatcagcgttatccaacgcctgcttttactcatactgattgccctttggcatcctcaaatttgttctgcgccattaagatcaggtcacatacttcgcgaactgcaccgcgtccaccggcaatccgcgtgacataatgcgcgcgcggcaacaggatcggatgtgcatccgccaccgccacgcttaatcccacttttgccataaccggccagtcgatcagatcgtcaccgatgtaggcgacctggtcgtcggaaagagacagtttatccagaagttcacgataggccaaaagcttatccgattgtccctgataaagatgacggatgccgagcgttttgcagcgatcttccatcaggcgcgcattgcggccggtaataatagccacttccacatcggaggtcagcaaacagcgaacgccgtaaccgtcccgcacgttgaatgccttcagctcttcgccattattccccatgtagatcactccgtcggacatcacgccatcgacatcgcagatcagcagacgaatcctgctggcgcgcgccataacgtcagcgctgaccgggccgtagcaggtttcaatcgggtgggttgcctgttgcattttctcttcctgttcagactacgccagcgcgcagcatgtcatgcatatgtaccacaccgagcagatggtcgtcatcggccaccagaatcgaggtaatgtttttggtctgcatcaggtttcagggcttccaccgccagcatattaggccggacgcggatgccacctggcgtcatcacttccccgatagtggcgcgctggaaatcgatgcccatatcaaagatgcggcgcaggtcaccatcggtaaagataccttcaattttcatcaggtcgtcgacgatcaccgtcagccccagatttttgcgggtaatctccagcagcgcatcgcgcagcgaggcgtcccgtgtgacgtgcggcagctcatcgccactgtgcatgatatcagccacatgcagcagcagtttacggcccagcgcaccgccaggatgggacaaagcaaagtcttcggcggtgaagccgcgcgcttccagcagcgaaaccgccagcgcgtcacccatcaccagcgtggccgtggtgctggtggtcggtgccagacccagcgggcaggcttcctgcggaacatggacacacagatgcacatcggcaacccggcccatcgcactgtcaggccgtccggtcatgcagatcagcgtaatgtgctgacgctttaaaaccggaatcagcgcgaggatttcgttcgactcaccgctgttggagatggcgatgaccacatcatttttgctcaccatgcccagatcgccatggctggcttcggccggatgaacaaaaaaagcgggcgtgccggtactggcaaaggtcgccgccatttttttgccgatatggccagacttgcccatgcccatcaccaccactttaccctgacaggcgtagatcagggcgcaggcgcgggcgaaatcgtcgttaatatattgatcgagttgttccagaccttcgcgctcaatgcgcagtacggttttccccgcctgctggaaatcaaatgctgttggttgctgatatgacatagtgagtctgtccttgttagccgtccatgaatgccggctgcatccacagcagcgtcacccagacgaagaaaccacagagtaaaaataagcctgccgttcggccaacgcggcggcgacgtagcaggcagagcagggcaaacagcacgctgactcccagcatcacccagtaatcacgggcgaaggcgtgataatcgacactgccagggtgaatcagcgccggcagacccagcacaatggcaatattataaatgttggcgccgatcagattaccgatcgcgatatcatcttcgcctttcagcgcaccggcaataaccgttgccagctcgggcaggctggtgcccacggcgatcagcgtcaggcccatcaccagctcgctgacgccaaaatagtcggcaaacgccgtggcattgtcgatcaccattcgtgtcgacatcggcaggataatcagcgcgacggccagccagagaaaggccaccgtatttccgctctcttcgcgtggcagctcggccagctgctcgcgggtcagggtgtcgttgttatcccgttctgctttacgcgcaatgcgaattaccaccatcagataaatcgcggcaatggcgatcaggcctattccatccagtcgactaagctgattgtcaaacagcatgaaaccgctgagcagggtaaccagcaacattaacggcagttcacggcgtatcagattagaatggacgctgagcgggtgcataagcgcagcggcacccaggatgagtaaaatattggtaatattcgagccgagcgcggtgccaacagcaagatccatctggccatgctgcgcggcggaaaaggagaggatcatctctggcagcgaggtgccgatgctgacaacggtcatgccaataatcagtggcgggatgccaaatgatcgacacagtatagaggcgctaaacaccagacgatcggcaccatatgccagtaaaagcaaaccgataatcagcagtgcagaagctacgaacatgaaaaatccttgcgtaaaaacccaggccggcaatgcctttcccgaccggtttaaggttctgtttggcgagacaggcgctgattttgaccgtccggacggcaaaagtaaatttaatgaccattttcgccaaatcttagcggtaagtttctgtaaagctatcgtgaatcaggaccgaacaggctaccatcgtaccccatgtttacgcccgatccttacaagaggttataatgatccagcagcaatcgaatctggttgaggttcgtggcgtgagtttttcgcgcggagatcgcaccatcttcgatgacatttcgctgaccgtgccaaaaggcaaagtgacggcgataatggggccgtcggggataggaaaaaccacgctgctacgcttgattggggggcaacttcagccgaccagcggtgaaatctttttccgtggtgaaaacattccgtcactgtctcgcactaaattgtacgaagcgcgcaaaaaaatgagcatgctgttccagtctggcgcgctgtttactgacctgacggtctatgaaaatgttgcctggccgctgcgtgaacatacccgtctgcctcctccgctgctgcacagcacagtgctgatgaagctggaagcggtgggtctgcgtggcgcggcccagctgaagcccgcggagctgtcgggcggaatggcgcgtcgtgtggcactggcgcgcgctatcgcgctggagccggaactgatcatgtttgatgagcctttcgtcggtcaggatccgatcacgatgggtgtgctggtaaaactcattgatgaactgaaccatgctctgggcctgacctgtattgtggtctcgcacgacgtaccggaagtactgagtattgcggactatgcctatatcgtggccggacaaaaaattatcgcacacggcaccacgccggagttgcgagcgaacaatgacccgcgcgttcgtcagtttattgatggcgatgcggatggtccggttcccttccgttttcctgccggcgactatctcgctgatttaaccggctcagggagtaactaaactgatggtgttgaaggcgctggcgacatttggacgtcagggaattgaaacgtgcgccagttttggacgcgcaggactcatgctctttcatgcgctggtgggcaagccagcgttccgcagacacacgccgctactgattaaacaactttatagcgtcggcgtgctgtcgctgctgatcatcgtggtttccggtctgtttatcggcatggtgcttggccttcagggttatctggtcttaaacacctatggcgcggaaaccagcctcggtatgctggtggcgctgtcattgctgcgcgaactggggccggttgtgaccgcgctgctgttcgccggacgggcagggtctgcgctgaccgccgaaatcggcctgatgaaggccaccgaacagctctccagtatggagatgatggcggttgacccgttgcgccgggtggtctcgccgcgcttctgggccggttttatcagtatgccgttactgacgctgatttttaccgcggtagggattgccggtggggcgctggtcggggtgagctggaaagggattgatcccggtttcttctggtcggcgatgcagaatgccgtcgattttcgtgccgatgtggttaactgcctgattaaaagtgcggtatttgccattaccgtgacgtggattgcgctgtttaacggctatgatgcgattccaacctctgaagggatcagtcgcgcgacgacgcgcactgtggtgcacgcgtcactggcggtgctcggattggattttgtgctgacagcactgatgtttgggaattgatgcaatgcaaagcaaaaaaagcgaaatctgggttggcatatttatgattatggcgttgctggcggcgctgtttctcgcgctgcgcgtcgccgatttaaagtcaatgggcaccgagccgacgtggaagctctacgccacctttgacaatattggtggtctcaaagccagttcgccggtcaagattggcggggtagtgattggccgggtgaccgacattgagttagagccgaaaacgctgctgccgcgtgtcaccatggacatcagcgatcagtatgcgaataaaatttcagacaccagctcgctggcggttcgcactcagggactgctgggtgagcaattcctggcactcaatttaggatttgacgatcctgaactgggttcggcgatgctgaaagatggcgatacgctgcgcgatacgaaatccgccatggtgctcgaagacctgatcggtcagttcctttataagagcggcgataataaacaaaacagtgaaaacaaggatgcgcaggaaggcgacagtgctgcgcctgcggcaccggctcaaccttaaagaagagggtataccatgtttaaacgtttactgatgattgccatgctggtggttgcggtaccgctgacggcaaccgcagccgatcagagcaacccctacaaactgatgaatgaagcggcgcaaaagacgttcacccgtctgaaaaacgagcagccgaaaatcaagcaggaccctaactacctgcgtcagattgtgcgtcaggagctgctgccttatgtgcagatcaaatatgcgggcgcgttagtgctgggccgctactatcgtgattcgacgcccgctcagcgtgaagcctacttcagcgcctttggtgactatctggcgcaggcttatggtcaggcactggcactgtacaacggacagagctaccagattcaacctgagcagccgttaggcgatgcccagattgtcgctattcgcgtttccattatcgacccaaatggtcgtccaccggttcgcctcgacttccagtggcgtaaaaacagccagagcggtaactggcaggcgtatgacatgatcgctgaaggcgtcagcatgatcaccaccaaacaaaatgagtggagcgatctgttacgtaccaaaggtatcgatggtctgacggcgcagctgaaatcttctgcggcacagccaatcacgctggataaacaacaataatgcacgaatcgttacgctgggaacgggaagccagcacgctattactgaaaggcgaactggatcgcgacacgttgatgagcctgtggcagcaacgtgaaacgctgattaaagatgttgataccatcgacgtcgcggcgctggagcgtgtggactcttccgggcttgccctgctggtgcacctgcgggaaatcgcgcgagcacagggtattacccctcgctttacgggcatcagcgacaaactgcattcgctgattacgctttacaatctgcaacagattattgtttctgcggataaaagcgcctgatatccggttgttatgctaagcccctgttttcaacaggggcttttgcgtatttaagagtcagccgctttcctctactatgtcagccttattattattaagtgaagttaagcccaatggaaaacagtgaaattcaggccgtgctgatggcagcattgcctttagacgaagtgcatgtgatgagcaatgatggcagccattttcaggtgatcgccgtaggcgaactgtttggcgaactgagccgcgtgaaaaagcagcaggctgtctacgcgccgctgatggaatttatcgcggataaccgcattcatgctgtctctatcaaaacctatactcccgctgaatgggcgcgtgaccgtaaactcaacggtttctgatccccagcgtggtgaactcgtcgctggcgagtccaatctttagctagttaattgagagccgtgttaatggacaaatttcgtgtgcaaggccccacccgcttaagtggtgaagtaaccatttccggggcaaagaaacgccgcgcttcctattctgtttgctgcgctgctggctgaagagccggtcgagatccagaatgtgccaaagctgcgcgacattgataccacaatgaagctgctgagccagctgggtgcgaaggtggaacgcaacggttctgtgcatgtcgatgccagcgcggtagatgtattttgtgcgccttacgatctggtcaaaaccatgcgtgcctcaatctgggcgctgggcccgctggtggcgcgttttggtcagggtcaggtttccctgccgggtggctgcgctatcggcgcgcgtccggttgatctgcacattaccggtcttgaacagctgggtgccgagatcaagctggaagagggctacgtgaaagcgtcagtcaatggccgcctgaagggcgcactgattgtcatggacaaaatcagcgtcggcgcgaccgtgaccatcatgagtgctgcgacgctggcgaccggtaccaccgtgattgagaatgcggcgcgtgagccggaaattgtcgataccgccaacttccttaacaccctgggcgccagaatcagtggtgcaggcagcgataaaatcaccatcgaaggcgtagagcgtctgggtggcggtgtttatcgtgtcctgccggatcgtatcgaaaccggtaccttcctggtggctgcggccatttcgggtggcaaagtgatgtgtcacaaaacccagccggatacgctggatgctgtgctggccaagctgcgtgatgcgggtgccgatatcgaaaccggtgaagactggatcagtctggatatgcacggcaagcggccaaaagcggtcaacgtgcgcactgcaccgcatccaggtttcccgaccgatatgcaggcgcagttcacactgttaaacatggtcgcggaaggcacgggcgtaattaccgaaaccatcttcgaaaaccgtttcatgcatatcccggaactgattcgtatgggcggacatgctgagattgagagcaacacggcgatctgtcatggggttgaaaccctgtcaggtgcgcaggtgatggcgaccgatttgcgtgcgtctgccagcctggttctggccggttgtattgcggaaggaacgacgtttgttgatcgcatttatcacatcgatcgtggctatgagcacatcgaagataagctgaaagccatgggcgcaaacatcgagcgcgtcagcgaagaataatcccgcagatgctctgaaagagccagccccctttgggggctggttttttttcgcctgaggatcgcctgagttttcaggcggtatcggaatgatcgacaggcgcccggatacgttttctgcgatccagcaggcagtgggtctcgggatcgtaatagcggctgggccagatctcacaaggatgaaccttgatcgcgtcagcgatcaaccattcgcccttgggccatggacgcgtgagcgcattagccagcgttgatgaactgagacctgctgcgcgtgatagcgccgcgagtgtcattccacgcttatgcagcgccgcgataatgtcagccgggtgccagtcttccatccttttttgcatatcctgttctccttttccctgtcattgcgtcgtccagcaggacgtgagctttcctttttaccgttatctggaaagattgaggtttttatagcaaatagttcccattagtttccagtaatatttggattcagcatctgatctgtggggtggcatgcaaaaggagtgcaacagctaagagataacaaaaagaagtgagagcagggacgtaaaacggagcctgtcaggctccgtgagggatcagaaatcgcgctgaactgacatgtgcgccagcgactccagcgcactgcgccacggcgattcgggcagaatacgcaaggcgtcaatggctttatccgcttcctgttcggcgcggctgcgcgtccattcgagtgaaccacactgattcatcgcttccagtaccggttccagcagatggcggccatttccctgctcaatggcttcacggatcatcttcgcctgctcaggtgagccgtgctgcatagcatgcagcagtggcagcgtgggtttgccttcactcagatcatcgccggtatttttgcccagcgtctcgccgtcagcactgtaatccagtaagtcgtcaattaactggaaagcggtgcccagatagcgcccataatcctgtagcgctttttcctcttcaggtgtggcttcagccagtatcgccgaggcctgcgaggccgcttcaaacaggcgcgcggtcttgctgtaaatcacgcgcatgtagctctcttcggtgatgtcgggatcgttgacgttcatcagctgcaggacttcaccctcagcaatcacgtttaccgcttctgacatcagcgccaggatacgcagcgaacccatgctggtcatcatctggaaggcgcgggtgtaaataaaatcaccgaccagcacgcttgccgcattgccaaacgccgcgtttcgcggtcgctttgccacgacgcatatcggattcatccacgacatcgtcatgcagcagcgtggcggtgtggataaattcgatcagcgccgcattggtcacgtgcagatcgcccttgtagcccatggcacgtgcggatagcacggcaatcatgggacggatacgcttgcccccaccactgatgatgtagtagcccaactggttgatgagcgagacatctgaattcagctggtcgaggatggtctggttaacggcagccatatcctgtgcggttaattcattaatctgttctaagttcattcgtcttttcagctatgactcgttatctctgccatggtaagtgcttttacccagccagcgttcaggtaatctgttactgattgtacttgaattttctgcctgagaaacggttgcattcagcctgtgttttttttctgcaagagtgtgcaaagtgctcttgtcttcttctggagttttgcgtagaattcgcgccctattgtgaatatttagcgcgccgcctgatgaactaaaaggcaagcgcagaagcggagttttatatgtacgcggttttccaaagtggtggtaaacaacaccgagtaagcgaaggtcagaccgttcgcctggaaaagctggacatcgcaaccggtgaaacgattgagtttgaccaggttctgatgattgctaatggcgaagacgtgaaaatcggcgcgccactggtttcaggcggaatgatcaaggcagaagttgttgctcacggtcgtggcgagaaaattaagatcgttaagtttcgtcgtcgtaagcactaccgtaagcaagcaggccatcgccagtggttcactgatgtgaaaatcactggtatcacggcataagaggagatctgacaaatggcacataaaaaggctggtggttcgactcgaaatggtcgtgactccaatgcaaaacgtctgggtgtaaaacgtttcggtggcgaatctgttctggcaggtagcatcatcgttcgtcagcgtggcaccaaattccacgccggtaccaatgtaggttgtggtcgtgaccacaccctgtttgctaccgcagacggtaaagtacagttcgaagttaaaggtccgaacaaccgtaaatacatcagcatcgttgctgagtaaggttgtcgtgacgcagacgtttaacgtctgaacgcacgaattgaaggccccgcagctcctgcggggctttttacattctgcggtctgttgcggtaaaagcgacgcatcacaaaagtttgctgtacactttatgtacgcactggcgaaagccaatcctgatttatccgccgctggtcagcgcagaagaccctggcggacccgtctgcagagtgctgcaggcgattgtgtgacggagatagaaaatgaagtttgtagatgaagcgacaattttggtcgtcgccggtgatggcggtaatggttgcgtaagcttccgccgcgaaaaatatatcccgagaggcggccctgatgggggtgatggcggtgacggcggtgacgtttatctgatcgctgatgaaaacctcaacacccttatcgattatcgtttcgaaaaatctttccgcgccgagcgtgggcagaaacggccagagccgcgactgtactggcaaacgcggtaaagatatcgaagttaaagtgccggtcggcacccgggttatcgatcagggtaccggcgagacactgggcgacatgacgcgtcacggccagaaactgatggtcggcaaaggcggctggcatggcctgggtaacacccgctttaaatcatctgtaaaccgcagtccgcgccagaaaaccatgggtaccccaggtgaaaagcgcgatctgcagctggagctgatgctgctggcagatgtcgggatgctgggcttaccgaatgccggtaaatcgacctttatccgtgccgtatcggcagcgaagccaaaagtggcggactatccgtttaccacgctggtgccgagcctgggcgtggttcgtatggacagcgagcagagcttcgtcgtggccgatatccctggcctgattgaaggcgcagccgatggcgcaggcctcggcattcgcttcctgaagcaccttgagcgctgccgcgtgttgctgcacctgatcgacatcgaccctatcgatgaaagcgatccggttgaaaatgcccgcatcattctcggcgagctggaaaagtacagcgagaagctgttcaacaagccacgctggctggtcttcaacaaaattgatctgatcagtgaagaagaagcgcagtcacgggctaaagcggtggctgaagcactgggctgggaagataagtattacctgatttctgccgcaagccgtaccggtgtcaacgaactctgctgggacgtgatgagcttcatcaacgctaatccgaaagaagcggagcttgaagagaagcagccggagaaagtggagttcatgtgggacgattaccacaaagaaaccattgaaaacacggttgaagtggaagatgaagagtgggatgacgactgggatgatgaagacgacgaaggcgttgaaattatctatcagcgttaaccgatcgcctgctacagcgtgatatgcaatgccccctttcaggcctgaaagggggcattgttctttctgcagctagctcatcaccgccacactcagtcgcgcactgcagcacagctgatcccgaccgttccgaatctcaatctgccagctctgactgcgtttacccagatgcagtggacggcaaattccccgcaccagaccggcagaaaccgcacgatgatggctggcattcacttctacgccaaccacgctgctgccttcttcaaccgccagatatccggcaattgagcccatcgactccgccagcaccacggacgcaccgccatgcagcagcccgaaacggctgttgcgtacgggcatcgaccggcatcgtcgcttccagataatcatcacctatcagggtaaaaacgatacccagatgggccaccagagagttctcacccagcgcattcagggcgggaagatcaatggatcgcttccagatcgctgtcatcatcaggctcccagggttgcgccaccatcaactacaatatcctgcagcgtcacatggctggcaagatccgacgcgagaaacagtacggtggctgcaatttcctgcggctgcgcgatcttgcccagcgggatacccagcttgaattgatccgggaagccggcaatcatctcctgctcacccgtcggtgtgtgccacaggctgcgctgcatatcggtgtcggtggaaccgggtgaaacgatgttgcagcggacgccatagggcgccatctccagacccacggtctgacagagactgcgcagcgccgcttttgaagcaccataagcggacatgccgatacgcggggcgtgagccgaattagacgcgacggtgacgatggcaccggcgcgctgttcacgaaagcgtggcaatgtctgctggaacagattaaacgcgccgcccgcattgacgttaagacacgcctgccagtcggcaaacgacagctcatcggtggcaccaatccgtaagataccggctgcgttgaccagcacatcaatgcgcggctgcgcagccaatacgcgctggcagatcgttttgacctgagccggatcggctacatccatcgtgtggcagggaaacggataatcatggcccttaaaacgttgatcaaaggcctcaacctgtgcgccagcctgatgaaaggctaacgcagtatgatagccgatgccctggccggcaccggttacccagacgattttaccgctgaagtcgaatgtgtggctcatttcgccggctcccgcgccagcagcgcccaccagccatcaatgctcggatttttcgccaggctgacgaaatcgatatcacgatgtacctgacgccagcgtgccgccagcgccatcacgcgtactgagtccagaccgtaatcaatcaggttttcatcatcttccggcacctcatcatcttccagcagcggcaggatcaacgcgcgcagatcatctttgctgagtggcacaggcatcagatcggcggtcatcaccacttttccgctacggcccgcagtgtaggtcagcgccatcatatgttcctctcggctgaaatcagccagcgcatcggccaccataaacggctggatattgcgcataaacgcatcggtggccgtagtcaggcagccaatatgagcatagacgccggtgataatcagctgatcgcggcccatctcctgcagtatcgactccagcggcgagcggtgaaatgcactgtagcgccatttggtcaggacctgatcgtcctcatccggtgccagcgcatccacgatcttctgctgatcgggatgtttattcaggcccggtccccacatgtcgttgagcagcgcacgatcttcatcgctctgcgcgtttggctgagcggtgtaatacaccggaataccctgcgctttgcagtagcgacgcaggcgggcaatattgtcgactacctgctcaaccagcgggctattttcgccccagaagttgagaaaatagcgctgcatatcgtggatcagcagggcggcacggtccggctccagcatccatttcactttgttgttgggcaactcggtggcggctggcagcggataagaggtcagttgtggaatagccattgaaaatctccggacagatcaggcttgcgcttgttgatcggcaagttgttggcgcagacgttttttgtccacctttccgaccgcggtcagcggcagggcatctacgcaggtaatacggtcgggcagcttaaattctgccacgccaagttcacgcaggtgacgacgcagcgccaccggtttaaccggctgacgggtgacgataaaggcacaactcttttcacccatcagctcgtcgctcatggagaccagtgcagcgtggatcacatccgcatggcgctgcagcaggttttcgatctcttcggctgcgatcttttcgccgccccggttgatctgatctttctcccggccctgcacgatgatgttgccagagggcgtgatctcaatcagatcgccagagcagtaaaagccctggtcatcgaagctggcggcgttatgttccgggctgttgtagtagccgcggaaggtataaggaccacgcgtcatcaggcgaccgatggagcctgctggcaatgggttaccctgatcgtcggcaacccatacctcgtcatccggggagatcgggcgtccctgcgtggtgagaatggtctgctcatcgtcatccagccgggtgtagttcaccagaccttccgccataccaaatacctgctgcagggtgcagccgatctcgttctggatgcgcgcggccagtgtttcacccagctttgcgccaccgacctgaatgcgttgcagcgaggccagcgcagcattgctgccccattcctgaatcgcctgcagccagagactggcggcgggcggaaccaggccggtatcggtgacctgatgcttttcaatcaacgggaagcagagcgttgcgctgggatcggcggctaagatcacctgtccgcccgcgtaaaaaacgcccagcgcgcccggcgaactcatcgggaagttatgcgcggcgggcagggcgatcaggtagcgggtgtcggcggtaacatcgcagataacgtcactctcacggatgctgtagtagtaatcattatgggtacgtgggatcagtttcggtgtaccggtactgccacccgacagctggaaaaaggcgacttcatcgcctgcggtcggggttgcgatgaagttgcccgcgggttcagccagcagggcgtcgaggctgttttccgtctgagcgtcattacgcaggatcacctgttgtagtgaacgctgatcgcggcgaagttgcgcaataaacgcatcatcggcgaacagtgcgtggctgcgatcggcaattaacaggctcggcgagatctgactggcataggcggccagttcagtgcgctgatggctgaacagggcgttaaccggggcaacgccgattttgaacagggcaaacagcgtcaggtaaaactcagccacgttgccaagctgcaccagcgccgtatcgcctgacttcaggccgcgacgctgcaatgccgcggccaggttgtcactcagcgccgccagctggcgataggtaaattgtcgttcgccatcaatcaccgctacgctctcgctgtcgcgatgacgttccaggatgtcggtcatcggcagatcgagccagtagcctttttcacggtaacgtgcggccagatcgtccggccagcggctgtaggaaatcgtcatacaggttcctttattgcagtccaaaagcgcgaagcatggtgtcgagtttgacgccggtttcacgccattctgattcaggttgtgagtccgctacgatgcctgcgcccgcaaacagccgcacccgcgggccattcaccgtaccgcagcgaatggtgacgacccattcgccattgccctgatcgtcacaccagccgacgatgccgccaaacagctgacgttcaaatggctccagtcgctgaatcagcgcctgagcacgctgatgcgggaagccgctgagggccggtgttggatgcagcagacaggccagtgacagcgcattttcgcgatcgtccagcacgtcaccctgaatctgcgtagcgagatgccacaatgttgcggtggtcagcagtgaaggtgtctcggggaccgacagcaggcggctgcgcggttgcagcgtcgcgcgcatcgcatccgtgaccagcttatgctcatgacgatcttttgctgagtgcatcaggctgtcgccagaggcctggtcacgctgcggatcgcgatgacgcggcgctgaaccggccagcggacaggagctgaactggcggccctgcttacgaatcatcagttccgggctggcgccaaccagcgcgccaccatcgggcagcggcagatgaaagtgatagctgttagggttctgcgccacgatgcgctgcatcagggcggccgtatcaaccggttgttccgccacgatatccatcagccgcgacaacaccactttatccagatcgccgcgctgcgtagccgccaccgcctgcgcaaccatgtcgatgaaaatgtcatggtccggcaccgccgtgcggcgacgcacctgcggcagttcagcctcagccagagaggcactggcgttgagatcgtcacggttaaaggtctgatacgactcagggataaacagcgcagtgggctgatccacgtcgaaggggattgcacccaccagaatgggatgggcaatgccctgttttctggctgaagcaaaatggtgctgtagttgctgctgaaactcccctgtcagctgctcaccctgccttaccggcgcggtaagggtagtaaaacagccctgtgtggtcaggctttgccagggagaggtaaacagaaagccacggcagagtgccgggaaatcctgcaacaagggatgttcaaacgccagcgattccaccataatttccacctataaatgataaggtaactaataatgattatcatttgtattgtgggccagtaacctacgttgattagccgaaagtgtcaataattacgcggcgattcagctggcatggccggttaaatcagcacaaatggtctctctctttttccgggtaaaagtggacgaaaatctatgagtaaacatggtgtcacatcggcgatagcgctgtttttcctgagcatcagcctgttcagcgttaccgctgctgcccagaccggctggccgcgaactgtcgccgggacaaaaggcaatatcacactgacccaggcaccgatgcgtatcgtttcgaccagcgttaccctgaccggctcgctgctggcgattgatgcgccggtcgtcgccagtggcgcaaccgcacccggcagtcggctggctgataagcagggattcttccgtcagtggggcgaagtggccaaacagcgcggcgtaaaacgtctctacattggtgagcccagtgcagaagcgattgctgctgaagcgccagacctgattgtggtcagcgccaccgggaatgattcggcaataaaactggtcgatcagcttgcggcgattgcgccggtgctggtggtgaattacgacgataaaagctggcagcaactggtgacgttgctgggtgaggcgaccgggcatgaagcggaagctgccgcccggaaagcagagtttgatgcgcgagaaaaggctctgaaagcgaagctgaccctgccgccgcagccggtatcagcgatggtgtggaacggtgatggccgggcagtcaatctgtggacggatgcgtcggcgcaggggaagttactgcagcaactgggcttcactctggcgacgccgccggccactcttcagtctggtcacagcatgggacagcgtaaagatatcctgcaactgtcaggagaaaatctggcggcaggccttaatggtcaatcatatctgctgtttgccgccgaagagcccaccgccgcacaggtgatgagcaatcctttcctggcgcagaccccagcggtgcgcgcaaaagcggtctatgcgctggggctggatagcttccggctcgactactacagcgccagcaatttgctgacgcggctggagacgctgttcgttaaatcatgatcccgtttccgccggtgcaggcggttgatagcgacgcagacgcgccatcagcagccacatgatgatgcccagcacggtggctgccagaccagccaggctggcagcctgctgcggcaacagcagtgaacccatcgcgccaatcatcgctgcacctatcgcatcgccggtgacattctgcgctgtccagaggctgttgatcctgccgagcagcgcatctggcgtcagcgtctggatcatcgcgtactgcaccaggctgttgatggcactgaaatagccaaagaccgcgaggcagaccagactcgcgctgaaccacggcatcaggctgaacagagccagcgcgacgaaagcagcaatagcactcgccagaatcaggcggcccggctgcggtgattgtgccagccgtccgctggtgagcgcacctgtggcagcacccagcggaacagcggcatacatcagccctaactccgtcacgccgacctgccagtgtggcgccagcgccggatagagcacgcgcaccgcactggctaacgtcaccagcgcgccgaccagcgccgccatgccaacaatcgggctggcaaacaggaattgcacgccgctggccagtgctttcagcggatgttcacgcggctgcggcggtggcgccagccgcggcaaccgcagcagggttaacaccgtcagcaacgtgccgaacgccgccagtccgtagttccacgccacaccgccctgcgcgatgaccagtccggcaatggcgggtgagagaatcgcgccaaatcgcaccgtcagcatggtaatcgcacctgctttcatcaggttttcacgcccgaccagcgccggcgtcgccgccagcagcgcggtgacgcctatcgcgccgaaaaaaccatcccacagtcccagcacaaagacggcgatcaccgacggcgaagggagcagggcattgatgcataaggcgacaaagcccaggccacaggtggatcgggcaaacaggatcagacgtcggcgctcatagcgatccgccagcacgccgccggtcagcaggccgataaacatgccggcaccggccagcgtcaccgccagacccaccagcagcggcgactgcgttagctgctgaatctgaaccggtaccgccaccgccagcatgccgagggcaacgatggagataaagcgggcgataaaaatggcgcgaaaggcggggtgggttctcagcaggctgagatcgataaagtgggagggtttgttcataacgtcgcttttttgcacccattttcctcatcattgagtccgggagtcatggtaacatacaaaaaatcactaataacgataacaagtatcattatcataatgactcgtgctgcgatctcaatgaatcggtgaaggtttaaacgttatgcgtcaacttcgtgcaatagcaggttcagggatgctgctgttgttgcttctcgcgctcagcctgatgctgggtgccaaatctatcccctttcatgatgtcacgcaggccttattcagcgactgtaaccgcgtcgattgtgtcatcgtgcgcgatgcccgactgccgcgcaccctggcgggtctgctggccgggatcagtttaggtctggcgggcgcgctgatgcagagcctgacgcgcaatccgctggccgatcccggcattctcggtatcaacgccggtgcgggctttgcggtggtgctgggcatcgccctgtctggcgctgactcccccgcggactggcttggctttgcctttacgggcgcactgctggcctccctgctggtggcgctgaccggtgcgctgggcggtggccgcgttaatccggtgcgtctgacgctggcaggcgtggcgctgggcgcggtgctggaggggttaacctctggtttatcgctgctcaatcctgacatctacgatcatctgcgtttctggcacagtggctcgctggatatccgcaattttgccattctgcgcaccacctttccggcggtagtcgccggtagcctgctggcgctgctgctggcgcgttcgctcaacagcctgagtatgggcggtgatatggcgaccgcgctgggtacccgggtgatgcgtacccagctggtgggattactggctattgctctgctgagtggggcggcgacagcctctgtcggtcccatcgcttttgtcggcttaatgacgccacatctggcccgctggctgctgggtaacgatcatcgctggatgctgcccggaacccttcttatcaccccctgtttgctgctggccgccgatattctgggacggctgctggtaccgggcgaactgcgcgtgtcgattgtcacggccatactgggcgcgccgatgctgattgtgctggtgcgccgcaagtcgggaagagggcagatatgaaacgggtgatggttaatgcgctgatgctgctggtggcctgcggggtgctggcctttctgagcattacgcgcggcaccttaccgatctccgccagccagttgtgggcccttatcaacggcgaggcggcgcgtaacatacagttgattgtactggagtggcgactgccgcgcgtcatgatggcgctgctgattggtgcggcactgggcgtcagcggggcaatttttcagtcgctgctgcgcaacccgctgggcagccccgatattctgggtttcaataccggcgcttacagcggcgtcctggtggcactggtgctgttccagcaaaacatggagggcatgacgctggcggcactgcttggcggactgctcacggcgggcgtggtctggctgttcagctggcgcaacggcgtggagacctttcgtctgatcattgtgggcatcagcgtgcgggcgctgctgatggcgctgaacagctggctgattatcagcgcctcactggaggcggcactgagcgccgggctctggagcgccggttcactcaacggcattacctgggcgaaaacgacgccggtgattaccgtgcttctgctggcgctgctggcgacaagcatgctggcccggcgcatgcgtctgctggagatgggtgacgacactgcctgcgcgctgggcgtaccggttgaacgcagccgcgttttgctgatgctgacgggcgtgatcctcaccgccgcctctaccgcgctggtcggtcctatctcctttattgcgctgctggcaccgcagattgctcgtcggctatgtggcggtatcaaaggcgcgctgccgctggctgccttgtgcggcgcgctgctgttaaccgccgcggattacgccgcgcagcactttttcctgccttatcagctgccggttggcgtcatcacggttagcctgggcggactctatctgattgctttactggtacgggaggcgcgacgccaatgacagtgaaaacacgtttgcagggcgacgcgctgacgctggggtatgacaaaaaaatcgtggcggagaatctcaccgtcgcgatccccgacggtgaactgaccgttattattggccccaacgcctgcggaaagtcgacgctgctgcgtaccttaagccgcctggtctcgcccctgaaaggccaggtgctgctggatggcaatgcgattgctcactacgctaccaaagaggtggcgcgtcggctggggctgctaccgcaaagctcgaatgcaccagcgggcatcagcgtcagcgaactggtcgcgcgcgggcgttatccgcaccagtcgctgtttggtcgctggcgacaggacgatgagacggctgttcagcaggcaatgcaggctaccggcgtggcagatttggcgcagcagcaggttgatacgctctctggcggccagcggcagcgggtgtggattgcgatggtgctggctcagcagacgccactgttgctgctggatgaaccgaccacctggctcgacatcgcccatcagattgagttgctggaattaatgcaggatctcaatcagcagcatggccgtacgctggtggtggtgctgcacgatctcaatcaggcgtgccgctatgccagccacctgattgcgatgcgagacgggaaaatcattgccgaagggaaaccggcggagatcgtcacgccggaactgatagaagcgatctacggcctgcgctgcatcatcattaacgatccggtggccggtacgccgatgattgtgccgctgggaagaggctgacctgcgctttcttcaggtggagaaagcgcaaagtcataacggttcagggattcagcgacgccaggcactgctgcagtcgtggcccaatctgttcgaacatgcgcggtgagatgatctcgacgtgcgcacagtccagcggccagatggtcagctcgccgacatagggcgcccaggcgcggcgcgcatcctgaccgggctgctgcgtctgttccgccaggaaacagggttgcgtgtccggtgaaacgggcactgcgcgctgttgccagcaggcgcaccgaactggcgtagttggcttcaatggtggtaaacagtgcctccattccttcaccggcctgctgccgttgcgcagcgataaactgctcgcgctcacgattaacctcttccagcaccgccggatccagcacgttttcaccgcgccgttcatcccagttctgcgtctccggcggccaggtatccagcagtccgaggaaggcaacggtttcaccttcggcctccagccgcgcggcgataccctgcgccagcgtgccacccagcgagtagcccaggaaatagtatggcccctgtggctgctgctgacgcaccgtcgccagatgcgcctcacacaccgcgtcaaggtgctgcgcctggttcagcgggctggtgatgtcgggtgactgaatgccgagtagcgaccagcgtgcatccagatagcgctgcaacacgctgaactgccaggcaaaaccggaggcgggatggaagcagaacagcgtcgggccagtgctgcgtcgcaagggtaataccgcttcaaatccggcacgagccacatccgctggctcgctgctgagcagtgtcgccagcttttctaccgtggatgccaccatgatctggcccactgacaccggctgattcagcgtccggcgcagctgtgctgccagccgcatcgccagcagcgagtggccgcccagcgagaagaaatcatcctgggcgctcaccggttcgcactccagcagcctggcaaacgcctgtgccagtgtcgtttcgagtccgggatgcggcgcgcgaccagccagcgctgcctgcgtttgcggcagcggcagcgctttgcgatccagtttaccgttgctgctgagcggtaacgccgccagctgaacaatcgccaccggcaccatatgcgccggtaactgtgtggccagagtctgacgcattgcgtcggtatcgatcgggccatcagccaccacatagccgaccagctggcgggcatcgccctgctgatcgctgctgctccccagcaccaccgcatgtgtgacggcctgctcaatgccaggtagcgcagccatggcgtggtcgatctcgttcagctcgatacgctgtccgcgaattttaagctgatcgtcgctgcggcccagatactccaccgcaccatccggcagccagcgcgccacatcaccggtgcggtacatccgggagccgtgaccccacggatcggcgacaaaccggctggcagtgaggtcgggacgatcaagatagccatgcgccagctgcacgccggtcagatagagatcgccagccacgcccggtggcaccggctgcagacgcgcatccagaatccgtaagccggtgttccagaccgggaagccaatcggcacgctggccccttcgacggccgccagctccgggccaaaggccggatagtagctgacatcaaccgccgcttcggtcgggccataaagattatgcaagggcacccgggtcagcgcctgccactggcgcgatagctctgcgggcagcgcttcgccgctacagaaaacccggcgcagggtggcgcagcgcgctatcgcgtcaccttcctgcagcgaagcgacaaaagcagccagcatcgacggaacaaaatgggtggtggtcacgcggtagcgggcaaacagctgctgcagcgcgtccgggtcgcgatgagcgtcgggcggagccatcaccagccgtgcgccgacgatgagcggccagaagaactcccataccgaaacatcaaagctgctcggggttttctgcaacaccacatcatcgctgccgagcggatagcgatcctgcatccataacagacggttgacgatcgcctcatgactgaccagcaccccttttggccgaccggtcgagccggaggtatagatgatgtatgcgccatcctgtggacgcggggcctgcatcagcacgctatcaacgggtgttaacagcgcgtcgtaaaacagcggcgcgacgggtgagagtgccgccagccgctcggccagttcacgacaggtgatcagcgttttcggcgcggcatcttccagcatcatctgtaaccgatcgtccgggtagccggtatcaagcggcagccaggttgcccccacgctgacgatcgcctgcagcgccagcgataaaaagaccgaacgcggcagcgctacggcgacgatatcacccggcgtcactccctgcgcaatcaactgttgccccagcgcggcgacctgctgctgcatctgttgatagtcaagctgatgcccctcatctgccagtgccggagcgcgcggcgaacgctgtgcctgacggagcagcaggctgctcagggtttctgcaggcagcattacggcagtctggttgatcgccgcgagctgctgatgctcttccggcatcagcatgtccagctcgccacaggcactggctggccggacggcaagctgctgaagcagcaggccaaagcggctggcgtgttgctttagcgttgtgtcgctgtagcgctgtgcattagccagtaactccagcgtcaggtcgccctgtttcgctgaggtagatagcaatctccagatcgcgtaccggtcctgacgccagctgatgggttatgcctttgatgccagcgaaatcgagctggtaatcaaacatcttcagattgattaccggcccatagagcggatcgctgtcgccggagcgacccagatcgcgctgcacctgttcagcgtcgtaacgctgatggcgacgcatttttttgacttcgtccgccagacgcccggccagtgccgtcagcggctgtgccggatcgtaatgcaccgccattggcagcacgttaatcaccggaccggtggcgcagagcgcggccgagccgatgcggcgcataaagatgaaaccggcggcgaacgcatgctggccggtgaggcgcgccagccataaggccaccagcgcaaaggcggtatccgcagcactgaggttgtactgcccggtgtgcgtcagcaaagcctgaaacgtgtcgcgatccacggcaaacgtatggcgcagcaggtcggtactggcgctctgaccggccagcggcagagcggacaacgaggcgggcgcaggtagctgcgcgcctttctccagccagaactggcgatcgcgctgccagcccgaagattgctgatagcgctgatattcatcaacgacgtcgctgaacggcacaaacgggcttggctccggcgtgtcgccgcgctgccaggcgctgtaaagattggcgatacggcgggtcagggcggtgaaactaaaaccatcgaccaccagatgatggtatcgctgataccagtaccagtgatcctcgcccagccgaagcaggctgtgatggtaaagcggcgcgccgctcagcacccgcagatcgccggtcatatcctgctgcatcagcgcacgtgcttcggcctccggatcggcggcatcgcgcagatcgatcacctcaggctcgcggaaatcctggggttcaggccactgtagcggttcaccctcctgctcgccaaaggccatattcagtgtgtccgcttcctgcatgccagcaattatggcccgtgacagcaacgcgctgttcagcgcaccgcgcagttccacaaaatgcgccacggcgtaagcattggaatagggcgatagctggtcagcgatccagattccgggctgagcggccaccagcggcagcgttttttgttctgtctgcgggttgagggtgatctcagacattttcgcctctgtcctgcgtcataaccggacggatatcgtgccagttttcattcagccagctcagacagtcagcctgtggcccggggccaaacaccggctgccatcctgccggaaccgcacaaaaggcgggccataagctgtactgctgctgatcgttcttcagcacctgacaatcctgttgcggatcgtcgaaagggttaagttgttgcatgtcggtctcctgtccgcagtcaccgggcgcgctaacgccgctgtcctgcatatccgatatctttcagtggcgcgcagaaggcggaatataagcgggttagggctattgccacatggctttaaggcctgccagcagtccaccgcgccagcacagcgcatcgtgaccgccttcgaccgggtgatagctgacctgatgtccggcagcggtcagatcgtgctgaaactgctggtttgctgccagaatcagccgttcgcgtcgtcccgcttccaggtagaagcggcgagggggggcctgcagtaagccctgttgtaactgctgtggcagccagccattgggatcgccgcgcgcgggccaccagaaacgacccggagaggctgatcgccccagcaaaggtttccggccaggtcagggtggcgtaagcggcagaaaggccgccaaaactctgtcccgctaccagcgtgctgtcggcacgaaacggcgcccagcgctgaacctgcggcaacagctcgtgctgaatcgccagccagaagtcagggttacaggtcagctcacgcgtgcggtgttcgcggtcgatgatgtcgatcatgacatagaccgcagggggcagttcgcccgcctctgtcagttgctgaagcgggccggcaaccggcatgttctgtgcccagaactgaccatccagcagcagtaccagcggacgatcgcctgcactggtgtctcccgtgacagagatccagatctgacgctggttccccagccgttcgctgcgccacaaatagtgttgcagcggaatatcggcggcacggccctcatcaaccgcacgccacacctgctgatccggcgcgtgtggcaggtgcagtggcgagaccctcattccgcgtccacccgcccagcttcgcaaaggattcagcgggtcgctttgcgcctgcgggaatttctgactccaccactggcgcactgcctgcatatcggcctgcccggtaaaagtctcttcctgactatcaggaatcaggcagtagctgccgcgccagtcagcgggcagggcggtttgccaccaccagacatcggtatcgggaacaggcgttaatgaggaggggaccgctgaatgatgatgatcggttacgccggtaatattgatccagacgcgccgggtatcggagtgctgcgtgtcaccctgaggatcgcgccagaaaaaggtgacctgacaggttcccttttcgccagcttcaaccagaggaatgccccgttgctgctgctgttgccaccagcgttcactgccggtttcttcatttaaccacgtcatacgcgccatctttcgatcacccttgattagggtcatgcatgttatgaataatagtattgataattatttgcatttgcaatagggtgtttccgcccgacagggagcgcgcgcatcctctctgccgcaccggctttcagactgatgcaaagcgcttctgacgctggcccggcgacaaggggaaaacgttgcaggcaaggttattacttttttaccggcacgccggcagtggcatcctcgccggcactccaggaacagaaaaatgaaaaagttatcccggctttcgttagccattatgattgaactgggtttcaccgcctctctcatttctgccggtgccgtggctgctgaagccacccgcgaaccggttatcgacagcagcccctccgataccctccacgacgacaccatgatggtgaccgccgccgagcagacgttgcaggcacctggcgtgtcgaccatcaccgccgacgaaataaaaaaacatccacccgcacgcgatgtcgccgaaattattcgcaccatgcctggcgtcaatctgaccggtaactccaccagcggccagcgcggaaacaatcgccagatcgatatccgcggcatggggccggaaaataccctgattctgatcgatggattgccggtgaccagccgcaacgcggttcggcttggctggcgtggcgagcgtgatacgcgcggcgacactaactgggtgccgccagagatcattgatcgcattgaggtgatccgcggtccggcagcagcccgttacggtaacggtgcagcgggcggcgtggtgaacatcatcactaaaaaagagatggataatcagtggcacggctcatggagcgcctattacaacgtgccggaacacaaggaggagggcgcgacccgtcgcaccaacttcagccttgaagggccgctgggcgatgatgtcagtttccggctctatggtggactggcaaaaacgcaggctgatgcttacgacattaatgaagggcacgccgcagaccgcaccggcagttacgccggatcgtacccggcgggccgggaaggctcgatcaacaaagatattcatggcctgctgcgctgggcatttgcgccgatgcagacgctggaagtgggggccggttacagtcgtcagggcaacctctatgccggggacacgcagaacaccaataccaacgccctggtgaaaagcaaatatggtgacgagaccaaccggctctatcggcagaacttttctgttaagtggaccggtgcctgggacaatggcatcagcaccaatacctacgcgcaatatgagaatacccgcaacgcgcgtctgaatgaggggctggcgggcggtaccgaaggcatcttcgccaacagcaacttcaataccattcagctggatgatgtgttgctgcacagtgagatcagtgtgccgtttgaatggctggtgaaccagaccgcgactttcgggacggaatggaatcagcagcggatgaaggatccttcatcgacgactcaggccgccagctacgggtcgattcccggtatcgctacgaccggccgcacaccctattcgcaggcggagatcttctcgctgtttgccgaagacaatattgagctgaccgacagcaccatgctgacgccgggcctgcgcttcgatcaccattcgattgtcggcgataactggagcccgtcgctcaacctgtcacagggattaggcgatgagttcacactgaaaatgggcattgcgcgcgcctataaagccccgagcctctatcagaccaacccgaactatctgctctacagcaacggtcagggctgtgccgccagtgccggtgcctgttatctgatgggtaatgacgatctgaaagcggaaaacagcattaataaagagattggggtcgaatggaagcgcgacggctaccaggcgggcctgacctggttccgcaacgactatcgtaacaagatcgaggctggcacggcgccaaccggcaccgcatctaacggcaaaaccgacatctacaaatgggaaaatgtgccgaaagcggtcgtcgagggactggaaggcacggttaatgtcccgttctccgacagcgtaacgtggaacaataacttcacttacatgctgcagagtaagaataaagagaccggcgatcgtctgtcgattattccggaatatacgctcaattcgacgctgagctggcaggcgatgcaggacctctccctgcaaacgaccctgacctggtacggtaaacaggtaccgaagaaatatgactataaaggtaacgccgttaccggtagcgccaccgatcaggtgagcccctattcggttgtgggcatgagcggcacctatgacgttaataaatatgccagcgtcaccgtgggtatcgacaacctgttcgacaagcgccatttccgtcagggcaacgcgcagaccaccggcaatgccaccaccggagcgtggctctatggcgcaggggccaatacctttaacgagtcgggccgcacctggtatatgagcgtgaatacccgcttctgatggacgggcaataaaaagcgcagcggttgatctgaccgctgcgctttttttatgactgaataatcagttgttctgattgatatcgcggtagagacggctctcaaatcgcaccagcggaatacggcgggtacgctgatcttccggcgggaccgcataaccggaaaggaactgaacgaatgccacccgcgcaccactggaggtggtgataaagcccgccaggttatagacgccctgcagtgagccggttttcgccgagactttgccatccagccccgcctcatgcagcccgccgcgatactgcagcgtgccgtcgtaacctgccagcggcagcatcgaaatataatccagcgtgttgtcattcttcgcaatgaactgcaatacctgcatcatggtttgcggcgaaatcaggtcatggcgggagagacctgaaccatccacctgaatgctattacccatgtcgacattggctttggctttcaggatgcggcgaaacggcatcctgtccggcgcggaacgtgccgggcacattgaagtagtgatgaccaatggtgcgaaacaccgtgtcggcaatcatgttgtctgacttcttcagcatggtgtgcagcagcgtatgcagcggcgcggactgggtcgatgccagcacggtacccggttcggtgacctgcgtctgtcgcaccagatgcccgctgtaatcaatctcagacgaccgcagttccgccttgaggatttcgccagcccaggccgcgccatcctgcaccgcaaatgccagcggcagtggttccgcgcgctggcgcatacagcccgtgagggtgtagcggttcagctcgcccggcaccacatccagctcgcaatattgcccttcgccgctgttgcggccaatggtgcgcacctggctgtacatatgcgccggataataggaggcgatacgtacaaaggcattctcacccggcgtattagcactgtagagcgacaccgagaagcagtttttatcaacgattgccgcacccggcggagcactgaagcactgggtcatatcgttccacggccagcccggcgccatatcgtgactggcaaaaacggaggtgtcgataaccagattgcctttgatatggttaatgccctgcttctttatcgccgccaccatgttgcgcagatcctgacggcttaaggtgggatcaccgccgaaacgtgcgactaaatcgccgttcagggtgccatcgataatggcgccacgagtctcaaaagtggtctgaaaacggaagtcgccacccagctccagcaatgctgccagcgccgtcaccactttcatggtactggcgggcagagccatctgttttccgtgataatcaataatcggtgttgatgcgcctactttttgtaccatcagcgccagattggcgccgtctggcaggtactgcatgtattcatcaactggcgctgcgtgtgcctgcagcataaatgcgcagcttaatccggtaacaagtcgtgaaaatcgcataatctcgcggtaactggcaggtgagggcgtcaatactacgtcgctggacggtgcaaagtaaacgatgacccgcagggaaactctggggtaaaatacgtatcaaattgcaaaactcttttctggcctggaagcatctccgggtcaggattcttttatttgcaaaaacgggctaatgcgccgcagaacgcttttttctgcagtcaccggtcaggatgacatcgttaaacaggaaagatggcgaggagcttaaatgaatcagattccgatgacgttaagaggcgctgaaagattgcgcgaagagctgaacgagctgaaaaccgtgaagcgcccgcgcattatcgcctctatcgctgatgcacgcgaacatggcgatttaaaagagaacgcggaatatcacgctgcgcgtgaagagcagggtttttgcgaaggccgtattcaggagattgaagccaaactctccaatgcgcaggttatcgacgtcactcagatgccgaaaaccggacgcgtgattttcggtgcaaccgtcaccgtgctgaacgtcgaaaccgacgaagaagccacgtatcgcattgtgggcgatgacgaagcggactttaagcaaaatctgatttcggtcaattcgccgatggcgcgtggcctggtgggtaaagaggccgatgacgtggctatcgtgaaaaccccaggcggcgacgttgagtatgaaatcctgaaggtggaatacctttaagatgttgctacgctttgaaaagcgttaaagcacaatgtaaagaaaggaaaaaggccgcattgcggccttttatctgaggtaagagcatgtcactttctttgcccacttagcgtggcagagaaattttgctctctttagaggggcgatacagcaccagcgttttgccgatcacctgtacgttgctggcaccggtctcacgcacgatagcctcaacgatcagctgtttcgtttcacgatcttccgaggcaatttttaccttgatcagttcgtgatgcgacagagcctgctcgatttcggccagcacgccttcagtcaggccattgccacccagcataaccactggcttgagcggatgggcgaggcccttgaggtgctgtttttgtttggtacttagattcatcgtagttttttacttactcagggattgaaaacggttcattctaccgccatctcgggtatatcaccaaatcgacgcaacccattgcgtgcaggtttatcgctacgatgacgatttagttggaaatattatgacgggtaaaaagcgttcggccagctccggccgctggcttcaggaacactttagcgataaatatgtgctccaggcgcataaaaaagggttgcgttcgcgcgcctggtttaaacttgatgaaatacaacagggtgacaagcttttcaaacccggcatgaccgtggtagatctgggtgctgcacccggaggctggtcgcaatatgtggtacagcaaattgggaacaaagggcgagtcattgcctgtgatatcctgccaatggatccgatagtcggtgtcgatttccttcagggcgattttcgtgaagaatcggtggtcaatgcgctgcttgaacgcgttggcgatcaaaaagttcaggttgtcatgtccgatatggcgccgaatatgagtggtacacctgccgtagatattccccggtcgatgtatttagtcgagctggcgctggagatgtgtcgggatatcctggcacctggcggcagttttgtagtgaaagtgtttcagggagatggcttcgatgaatacctgcgggaaattcgctccctgtttacgaaagtgaaaattcgtaagccggacgcttcacgttcacgttcacgtgaagtgtatattgtggcgactgggcgcaaactataaccaaattgctggagaagtccgcagttttgctgcgattccatgtatgcgggatctatagtaccctacgctatctgttaacaccgttgtaatatgaggttaatcccttgagtgacatggcgaaaaacctgattctctggttagtcatcgcggtcgtgctgatgtcagtattccagagctttgggcccagcgagtcgaatggccgtcgggttgattattcaaccttcctgtcggaagtgaaccaggatcaggtccgcgaggcacgtattaacgggcgtgaaattaacgtcgttaaaaaagacagcaataaatacacgacctacattcctgtcaacgatcccaagttgctcgataacctcttgaccaaaaacgtcaaagtggttggcgaaccgccggaagaaccaagcctgctggcttcaatcttcatttcgtggttcccgatgttgctgctgatcggtgtgtggatcttctttatgcgtcagatgcagggcggcggcggtaagggcgcgatgtccttcggcaagagcaaagcccgcatgttgacggaagaccagattaaaaccactttcgccgacgtagcaggttgtgacgaagcgaaagatgaagttgctgagctggtggaatatctgcgtgagccaagccgtttccagaagctgggcggtaagattccaaaaggtgttctgatggtggggccaccgggtaccggtaaaaccttgctggcaaaagcgattgccggtgaagcgaaagtgcctttctttaccatctccggttctgactttgtggaaatgtttgtcggtgtcggtgcatcccgtgtgcgtgacatgttcgaacaggccaaaaaagcggctccgtgcatcatctttatcgatgagatcgacgcagtcggtcgtcagcgtggcgccggtttaggcggtggacatgacgaacgtgagcagacgctgaaccagatgctggttgagatggatggtttcgaaggtaacgaaggtattattgttatcgccgcaactaaccgtcctgacgtactggaccctgcgctgctgcgtccaggtcgctttgaccgtcaggttgtagttggcctgccagatgttcgcggtcgtgagcagatcctgaaagtgcatatgcgtcgtgtgccgctggcaactgatgttgatgcagcaatcattgcacgtggtacgccaggcttctcgggtgccgatctggccaaccttgttaacgaagcagcgctgttcgcggcccgttcaaacaagcgtgtggtttcgatggtagagttcgagaaagcgaaagacaaaatcatgatgggtgcggaacgtcgctccatggtgatgacggaatcgcagaaagagtcaactgcctaccacgaagcaggccacgccattattggtcgcctggtgccagagcatgacccggttcataaagtaacgattatcccgcgcggtcgcgcactgggtgtgaccttcttcctgcctgaaggcgacgcgatcagcgccagccgtcagaaactggaaagccagatctcaacgctttacggcggtcgtctggcagaagagatcatctacggtgcagaacgtgtttctaccggtgcgtccaacgatattaaagttgcgaccaatctggcgcgtaacatggtgacgcagtggggcttctctgaaaaactgggtccgttgctctatgcagaagaagagggtgaagtgttcctcggacgtttctgtcgcgaaagcgaaacatatgtctgatgaaacggcccgcatcatcgaccaggaagttaagcacctgatcgacagcaactaccagcgtgctcgtcagattctgggtgagaacatggacatccttcacgcgatgaaagacgcgctgatgaagtatgaaaccattgatgcaccgcagatcgacgacctgatggcacgccgcgaagtgcgtccgccagcgggctgggaagatccaggcagcaactcagacagcaacggtacgccaaaggctccacgtccggttgatgaaccgcgtacgccaaacccaggcaataccatgtcagagcagtacaacaaataagacgcaacatcgtcagacaaaaccccggctggtccggggttttttacatccagatattgatcagcaaggagtttccgctatgaagttgttcgcccgtgattcccatctcgatttatcttttccacatgtgatgggcattcttaacgtcacgccggactccttttcagatggtggaaagcataacgcgctggttgatgcgctaacgcataccaatgagatggtcaatgcaggtgcaaccatcatcgatgtgggcggggaatcaacccgtcctggcgcggatgaagtgagtgtggaggaggagctggagcgggtgattccggtcatcgatgccattgcccagcgtttcgaagtctggatttcagtggacacctctaaagctgacgtcatccgggaagccgcgcgagtaggtgctcacatcataaacgacgtgcgttcgctttctgaacccggagcactggaagccgcagccgcgaccgcactgcccgtctgtttaatgcatatgcagggcgaaccgcgcaccatgcagcaggcaccggtttacgaaaatattttaagcgaagtggatacttacttcgctcagcagatagcgcgctgcgaagcagcgggcattaaaaaagagcgtctgatactcgacccgggcttcggtttcggtaaaaatctcagccacaattatgaactgctggctcatcttggcgattttcaccacttcggcctgccgctgttagtggggatgtcgcgtaaatcgatgattggccagctgttaaacgtcggcccgtcacagcgtttaaccggcagcctgagttgcgcggtgattgctgctatgcagggcgcgcagattattcgcgcccatgatgtaaaagagacggctgaagcgatgcgcgtggtcgaagcgacccgaagagcaaaaggagtatcatgagtaatcgtaaatatttcggtacagacggcattcgtggcaaagtcggtgaagcacccatcacccccgatttcgtcctgaagctgggctgggccgcaggtaaagtgctggcgcgccacggttcaaagaagatcatcatcggtaaagatacccgtatctctggctatatgctggagtccgcgctggaagctggtctcgccgcagcaggcctgacggccgcctttaccggcccgatgccgacaccagccatcgcctatctgacccgtactttccgcgcagaggcgggcattgtgatttcagcgtcacataacccgtttgacgacaacggaattaaattcttctcatccgagggcaccaaactgcccgatgacgtcgaagaggcgattgagctggagatggaaaagccgattacctgcgttgaatcagcgcagctaggtcgtgccagccgtattgtggatgcagcagggcgttacattgagttctgcaaagggactttccccagcgaaactgaatctgaatggcctgaaaattgtggtcgactgcgccaatggcgccacctaccacattgcgccgaatgtattgcgtgaactgggcgcgacggtgattgctatcggtgtccagccagacggcatgaacatcaacaaagagtgcggtgccaccgatctcaaactgctgcagcagcgcgtgctggcggagaaggccgatatcggcctggcctacgacggtgacggcgatcgcatcatgatgattgaccatctgggtgacaaagttgatggcgaccagatcctctacatcattgcgcgtgaggccctgcgtcagggacagttacgcggtggcgtggtgggtacgctgatgagtaacatggggctggagttagcgctgaaacagcttggcattccgtttacccgtgccaaagtcggtgaccgttatgtactggaaaagatgcaggagaagggctggcgtctcggtgcagagaactccggtcatgtgatcctgctggataaaaccacaaccggtgacggtatcgttgcaagtttgcaagtgctcactgcgatggtgcgtaaccacatgagcctgcacgatctctgtagtggcatgaagatgctgccgcaggtcctggttaacgtacgctttgcgggcgaacatgatcctcttcagagtgacgcggtaaaagctgtcacggctgaagtagaaaaagcgctggcgggtcgcggacgcgtttctgctgcgtaaatcaggtactgagccactgattcgtgtcatggtcgaaggcgaaaatgaggcgcaggtcaccgaactggcgaatcgcatcgccgaccaggtcaaggccgtttaaaacagtaacaggcggtctgcagggtgctgaactgcctgtaaaatcaccgggatggcgtttttttctgcaaacagtatgggtagtaaaaattgcacttgcagagatatgcgcctttggttagtattcacacccgcttctgatgggtgatgacgagactccccatcaatactggttgaagctttaactgtacgattaccgtgcaaggaacaggatgatatgtaccaagctcttttagtagttttccttattgtagctatcgccctcgtgggtatgatcatgctgcagcaaggcaaaggcgctgatatgggagcctcattcggtgcaggcgcatccggtacggtgtttggttcttcgggctcaggtaatttcatgactcgtactactggcatcttagcagcgctgtttttcatcatcagcctggttctgggtaatctgaacagcaataaagcgtctaaaggaagcgagtgggaaaatctttctgcgccggcgcagtcttctcaacagactgaaaagccagctcaaccggtaacgccgggcagcgatattcctaagtaaggtcgtcagcacaacgaatcgttgtggtcagtgcagtgccgtggtggtggaattggtagacacgctaccttgaggtggtagtgcccgattgggcttacgggttcaagtcccgtcctcggtaccaaatagcagtatcccttgcattttatgcaggtctggcgtattattcgccacgttttcggacgcggggtggagcagcctggtagctcgtcgggctcataacccgaaggtcgtcggttcaaatccggcccccgcaaccaattttccctttgagttctttttcaaatatactgtatgcatcgacggacgcattcacggttattttttgaaagaaaattctttggatggagtccgggccgcattgcggcatacagggtccagtgattaaaagccccgaatattcggggttttttgttattagcgaatcgtaatactgggctataggccctttttttatgtcttgggggtgggcttgtccacattagagcaaaaattgacagagttggtatcggctcccgtagaagcgctgggttacgaactggttggaattgaattcgttcgtagtcgcacatctatcctgcgcatctatattgatagtgaagatggcatcaatgtcgatgattgcgccgatgtcagccaccaggtaagtgcggtaatggatgttgaagatcccattacggtcccttacaacctagaagtctcttcaccgggactcgatcgtcctctgttcactgcagaacactacacccgctttatgggtgaagaagtgagtctggtgttgcgtatggccgtgcaaaaccgccgtaaatggcagggaaccattaagtcagttgatggcgagatgatcacggtgcacgttgagggtagcgatgaagtgttcgcactgagtaatattcagaaagcgaacctggtcccccacttttaaaagtccggattgaggctaaccaggatgaacaaagagatcttagctgttgtagaagccgtttctaacgaaaaagccctgccgcgtgagaaaatcttcgaagcgctggagagcgcgctggcgactgcgaccaagaaaaagtacgagcaggaaattgaggtacgcgtcagcattgatcgccgcagtggcgatttcgatactttccgccgctgggaaatcgtagaagaggtgacacagccgacgcgcgagatcacgctggatgcggcccgcttcgaagatgaagcattcaatctgggcgaatatgtcgaagatcagattgaatcggtcacctttgaccgtatcaccacccagaccgctaagcaggttatcgtgcaaaaagtgcgcgaagctgagcgcgcaatggtggttgatcagttccgtgagcaggaaggcgaaattatcacgggcgtggtgaagaaagttaaccgcgacaacatctccctcgacttaggcagcaatgccgaagcggtgattctgcgcgaagatatgctgccgcgtgaaaacttccgtccaggcgaccgtattcgtggcgtactctactctgtacgtccggaagcgcgtggcgcgcaactgttcgtgacgcgttctaaaccagaaatgctgattgaactgttccgcatcgaggtgccagaaattggcgaagaactgattgaaattaaagccgctgctcgtgatccgggttcgcgcgctaaaattgcagtcaaaaccaacgacaaacgtattgatccggtgggtgcctgtgtgggcatgcgcggcgcgcgtgttcaggcagtttccagtgaactgggcggcgagcgtatcgatatcgtgctgtgggacgataacccggcgcagtttgttattaacgccatggctccggccgatgtggcgtcaatcgtggttgatgaagataaccacaccatggatatcgccgtagaagctggcaatctggctcaggcgatcggccgtaacggccaaaacgtgcgtctcgcttcacagctgagtggctgggagctgaacgtgatgaccgtcgatgatctgcaggctaagcatcaggctgaagcacatgcagcgatcgatatgttcactaaacatctcgacatcgacgaagagttcgccaccgtactggtggaagagggcttctcctcgctggaagagctggcatacgtgccaatcaacgagctgctggaagtcgacggcctcgacgaagagaccattgaagccctgcgtgaacgagcaaaaaatgcgttaaccaccctggcactggcgaaagaagagagtcttggaaatcaggagcccgctgaggatcttctgaatcttgaaggcctcgatcgtgcgctggcgttccgcctggcgtcgaaaggcgtttgcacgctggaagatctcgctgagcaaggtgttgacgatctgacggatattgaaggcatgtctgatgaacaagccggcgcgctgattatggccgcacgtaatatctgctggttcggcgatgacgcgtaataacaggaaggaacagcatgacagatgtaaccgtaaaatcgctggccgcagaaattcagactccggtcgatcgcctggtacagcaatttgctgatgcggggatccctaagtctgaaaatgacgcggtgacccagcaagagaaagaaaccttactatctcatctgaaccgtgaacacggtcaggtcggttcagctaagctgacgctgcagcgtaaaacgcgcagcaccttgaatattccaggcaccgggggtaaaagtaagtcggtgcaaattgaagtccgcaaaaagcgtacctatgtgaagggtgatgcagaggctgagcaagctcaggcagaagctgaagccgaggcgcagcgtgaagcggaagagcaggcgcaacgcgaggctgaagaaaaagcccgtcgcgaagctgaacagaaagcgcaacgtgaagccgaagataaagccaggcgcgaagccgctgacaaggccaaacgtgcagcagcggaaaatgaaaaagtgacaaatcaacctaccgacgaagtgaccagggctgcgcaatcagacaaagcccgtcgcgaagctgaagctgccgaaactgaagcgtaaagctgaagaagaagcccgccgtaagcttgaagaggctgcccgcctcgtagcagaagaagcccgccgtctggctgaagagaaatcagctgaatgggaaaaaccggaagaagaggataaaggcgactatcacgtcaccacttcgacccatgcccgtcaggcggaagacgaaaacgaccgtcaggttgaagcaggtcgtgcgcgtgcgcgtactactgctaaagctgcgcgtccggcgaaaaaaggcaacaaacactctgaagccaaaactgaccgtgaagaagcgcgtgcgcaggttcgtggtggtaaaggcggcaagcatcgcaaacctagcgcactgcagcagggcttcaacaagccagcgcaggccgttaaccgcgatgttgtgattggcgaaactatcaccgtagccgaactggctaacaaaatggcggtgaaaggttctctggtcattaaagcgatgatgagaatgggcgccatggcgaccattaaccaggtcatcgaccaggaaactgcacagctcgttgccgaagagatgggccacaaagtgaccctgcgtcgtgagaacgagctggaagaagcggtaatggacgatcgtgatactgatgctgcgcaggagtctcgtgctccggttgtcaccatcatgggccacgtcgaccacggtaaaacgtccctgctggactatatccgttccactaaaatcgcctctggcgaagcgggcggtattactcagcacatcggtgcttaccacgttgaaaccgacaacggtatggttaccttcctggataccccgggccacgccgcgtttaccgcgatgcgtgcacgtggtgcgcaggcgaccgatatcgttatcctggtggttgcagcagacgatggcgtgatgccacagactgtcgaagctattcagcacgccaaagccgctaaagtgccggttgtggttgcagtgaacaagtgcgataagccagaagcggatccggatcgtgttaaaaacgaactgactcagtacggtatcattccggaagagtggggcggcgaaaacatgttcgttaatgtctctgcgaaagcgggtaccggcattgatgacctgttaaacgctatcctgctgcaggcggaagtgctggaactcaccgctatccgtgaaggtatggcgagcggcgtggtgatcgaatcgttcctcgacaaaggtcgtggtccggttgccaccgtgctggtacgtgaaggtacgctgaacaaaggcgacatcgttctttgtggtttcgaatatggccgcgttcgtgcaatgcgtgacgaactgggtcgcgaagtcatggaagcgggtccatctatcccggttgagattctgggcctgtccggcgtgccggctgcgggtgatgaagcgaccgtggtacgtgacgagaagaaagcacgtgaagttgcgctctatcgtcagggcaaattccgcgaagttaaactggctcgccagcagaaatctaagctcgagaacatgtttgctaacatgaccgaaggcgaagtgtctgaactgaacatcgttctgaaagctgacgttcagggttctgtggaagcaatctccgactccctgcagaaactctccaccgacgaagtgaaggtgaagattgtgggttcaggcgtgggcgggattaccgaaaccgatgcgaccctggctgctgcctctaacgccatcctccttggctttaacgttcgtgccgatgcctctgcgcgtcgcgtcattgacgcagaaagcctggatctgcgctactactctgtcatctataacctgattgacgaagttaaagcggcgatgagcggcatgctggcaccagagtacaaacagcagatcatcggtctggctgcggtgcgcgatgtgttcaaatcaccgaagtttggcgcgattgccggttgtatggtgacggaaggtaacatcaagcgtcacaatccaatccgtgtcctgcgtgacaacgtggtaatttacgaaggcgagctggaatctctgcgtcgctttaaagatgacgtcaacgaagtgcgtaacggcatggagtgcggtatcggcgtgaagaactacaacgacgttcgcgttggcgatatgatcgaagtgtttgaaatcatcgaaattaaacgcaccatcgagtaatagactgctgatgtgttgcaatttgggaggcctctggcctcccgaattatttgggagaaataatgatggcgaaagaatttggtcgcccgcagcgcgtttcacaagagctgcaaaaagagattgcgatgatcctgcagcgtgagatcaaagatccacgtcttggcatgatggtcaccgtatcaggcgttgaagtctcacgcgatctcgcttacgcaaaagtgttcgtgactttcctcaacgacaaagatgaagaagcgattaaacatggcctgaaagcgctgaaagaagcgtcaggttatatccgcattctgctgggcaaagcgatgcgtctgcgtatcgtgcctgagctgactttcttctacgacaactcgttagtcgaagggatgcgcatgtccaatctcgtcaccagcgtcgtgaagaacgatactgagcgccgtggtccggacgccactggcgatgacgaggaggcgtaatgagtcgtccgcgtcgtcgcggtcgcgacgtccatggcgtgttgttgctggataagccacaaggcgtctcgtcgaatgatgtcctgcagaaagtgaagcgtatctttaacgcgaatcgcgcaggacataccggcgcgctggatcctctggctaccggcatgttgccgatctgcctgggtgaagcgactaagttttcgcagtatctgctcgattccgataaacgctatcgcgtgattgcccgactgggcgagcggaccgacacgtcagacgccgatggcaacatcgtgcagacgcgtccggtcagcttcactcaggccgatctggacagtgctctggagagcttccgcggcgaaacgctgcaggtgccttcgatgttttcggcactgaagcatcagggacgcccgctgtatgaatatgcgcgtcagggcattgagattgcgcgtgaaccgcgtccgatcactgtctatgaactgcaatttattcgctggcaggataacgagctggagctggaaattcactgctccaaaggcacctatatccgcaccatcatcgatgacctgggcgaaaagctgggatgcggtgcgcacgtgattatgctgcgtcgcgtttcaggttgcccgttatccgtatgaaaggatggtgacgctggaacagctcaacaccctgctgacggaagccacagaagccggcattccactggaaacgcagctcgatccgctgttgttgccaatggacagccccgcctctgatttccctgaagtgaatatcccgcctgccgtagcagatttcttccgccagggacagccggtacaggccagcaatgcgcctgcccaggggctggtaagggtatcggaaggcgaagcgcgtaagtttatcggtatggcagaaattgccgacgatggccggcttgcgccacgtcgtttagtggttgagtatcaggattgagccaggcgttcacttttcgctgatggggcatttgcgttgctatcgggcgcagagtagaatagcgcggctttaaagcgggatgctgaattagagatcggcacccatacattcatttattactggagtttattatgtctctaagcgtagaagctaaagcagagatcgttgctaaatatggccgtggtgctaacgacagcggttcaactgaagttcaggttgccctgttgaccgcgcagattacccatctgcagggtcacttctctgagcacaaaaaagaccaccacagccgccgcggtctgctgcgcatggtatctcagcgtcgtaagctgctggactacctgaagcgtaaagacgttgcacgctacagcagcctgatcgaaagtctcggtctgcgtcgctaagtctgaagaatctgatcgtcggggcattatgcgggcttttgcactctgtgcagcttacgatcagatttgtgcgagtttcgtgaagagggggcctttatggccccttttttcgagcaatcggcagcaatccggaccaaactgatgtattgttgcttagtgtgatctttagtttgcagaatttcgcgcggctaatgagaggctttaccgcaggggcggtcgagggttgtcattagtcgcgaggatgcaactgaagattggtaatcaatggcgggctacagatagccatgccccgaagttaaggactttgattttgctgaatccgatcgtacgcaaattccaatatggtcaacataccgtcacgctggaaaccggcatgatggctcgccaggcgtcagccgctgttatggtgagcatggacgatactgcagtattcgtcactgtagtaggtcagaaaaaatctaaaccaggtcaggatttcttcccactgaccgtgaactatcaggagcgtacttacgctgctggtcgtatcccaggcagcttcttccgtcgtgaaggccgtccaagcgaaggcgaaaccctgatttcgcgtctgattgaccgcccgattcgtccgctgttcccggaaggttttgttaacgaagttcaggttatcgccactgttgtctctgtgaacccacaggttcatccggacatcgttgccatgatcggtgcttctgctgcactggcgctttctggtctgccgttcaatggcccaattggttctgcgcgtgttggttacatcaacgatcaatatgtcctgaacccaaccgcagatgagctgaaacagtctcgtctggatctggtggttgccggtacgcagaatgccgttctgatggttgaatctgaagctgagatcctgtcagaagagcagatgctgggcgccgtggtctttggtcacgaccagcagcagattgttatcgaaaacatcaatgccctggttgctgaagcgggcaaaccacgctgggactggcagccagaagcggccaataccgcactgatttctcgcgttgctgccctggcagaagcgcgcatcagcgatgcttaccgcatcactgacaagcaggagcgttacacccaggttggcgtcattaaagacgaaaccatcgctgcgctgctggctgaagatgaaacgctggatggttcagaaatcggcgacatcgtgcatagccttgaaaaaaccgtcgttcgtactcgcatcctgaatggcgagccacgcatcgatggtcgtgaaaaagatatgatccgtggtctggacgtgcgtactggcgtattgccacgtacacacggttcatcactgttcacccgtggtgagacgcaggcactggttactgcaacgctgggtacgacccgcgatgcgcagaaaccttgatgagctgatgggcgaacgtaccgacagcttcctgttccattacaacttccctccatactctgtcggcgaaaccggcatggtaggttcgccgaagcgtcgtgagattggtcacggtcgtctggcgaagcgcggcgtgttagcggtaatgcctaaagcggaagatttcccttacaccattcgtgttgtttctgaaatcaccgaatctaacggctcttcttcaatggcctctgtctgcggtgcctcactggcgctgatggatgcaggcgtgccaatcaaagccgccgttgccggtatcgcaatgggtctggtgaaagaagatgagaagtttgttgttctgtctgacatcctgggcgatgaagatcatctgggcgacatggacttcaaagtagccggtagccgtgaaggtatcaccgcgctgcagatggacatcaaaatcgaaggcatcacgcgtgaaatcatgcaggaagcgctgaaccaggcccgtggtgcacgtctgcacattctgggcgttatggaacaggctatcagcacaccgcgtactgagatttctgaattcgcaccacgcatttacaccatcaaaatcagctctgacaagatcaaagatgtgatcggtaaaggcggctcagtgattcgtgcactgaccgaagagaccggcacaacgattgaaattgaagatgacggcaccgtgaaaatcgctgcgaccgatggtctgaaagcgaaagaagcgattcgtcgtatcgaagagattaccgcagagatcgaagtgggccgcgtttacagtggtaaagtgacccgtatcgttgacttcggcgccttcgttgcaatcggtggtggtaaagaaggtctggttcacatttcacaaatcgctgataagcgcgttgagaaagtgactgactatctgcagatgggtcaggaagtaccggttaaggtgatggaagttgatcgccagggccgtgtacgtctgagcatcaaagaagcgacagaatctaagccgcaggctgaagaagctgtcacggtgaccacgcctgacgctgctgaataagtcgttgctgatttgcccctctctgcctggcagagaggggcgtttgtatcatcgcgagggcgggaatccttgtgcacagcaggcggatgacaggatggttatcccaatgtttgtattcgggagtgggaaatgaagccttttctgcgctggtgttttgttgcgacagctttgacgctggcaggatgcagcaactccaattggcgtaagaacgaagttcttgcagtgcctttacagcccacactgcagcaggaagtgatactggcgcgcatggaacaaattcttgccagtcgcgctctcaccgatgatgaacgcgcacagctgttatatgagcgcggagtgttgtatgatagtttaggtctgcgggcattagcgcggaacgatttttcgcaagcgctgtctataagaccagatatgcccgaagtgtttaactacttaggcatatatttaacgcaggcgggcaactttgatgccgcctatgaagcgtttgattctgtacttgagcttgatccaacttacaactatgcgcatttaaaccgtggtatcgccctctattacggcggtcgatacaagttagcgcaagatgatctgctggcgttttatcaagacgatcctaacgatcctttccgcagtttgtggctctatctcgttgaacgtgagatggatgtcgacaaggcaaaagtcgcgcttcaacagcgtcacgacaaagcggtcagagatcaatggggatggaatattgtcgagtttctaccttggagatatcaacgagaaaacgttgatggaaagtctcaaggcggacgcaacggataacacctcgctcgctgaacatctcagtgaaaccaacttctatttaggtaagtactacctaagtctgggggagaaggacgacgcgaaagcgttgttcaaactggcggtggccaacaacgtcaataactttgttgaacaccgatacgcattgttggaactggcgcaactcggccaggcacaagacgatttatcagaatctgaccagcaatagctgacgaacttaatttgcctgtaaaacctgttaagtcatcatcttaaaggatgaaggcttttctgttcgtcaaaacttttaatttgagccggttcacactttttgatgaaaatgactgaaagttttcacgacgagttatgtagactggccgccgcaatctaagaggcacgtgtactacatgactgatattcaaaccacttttgctgaccttggcctgaacgccgacatccttgaatcactgaatggcatgggctacgtaaagccatccccaatccaggctgagtgtattcctcacctgctggcgggccgtgacgtgttaggcatggcgcagaccgggagtggtaaaaccgcggcgttctctctgccgctgttacacaacattgatcctactgttaaagcgccacaaatcctggtgctggcacctacccgcgaaactggcggtacaggttgctgaagcagttaccgaattctctaaacacatgcgtggcctgaacgtggttgccctttacggcggccagcgttatgacgtgcagctgcgcgcactgcgtcagggaccacaggttgttgtgggtacgcctggccgtctgcttgaccacctgaaacgcggcacgttagacctttctaacctgcgtggcctggtgctggatgaagcagacgaaatgctgcgcatgggcttcatcgaagacgttgaaaccatcatggcgcaaattccagccgatcatcagaccgcgctgttctctgcaaccatgccggaagcgattcgtcgtatcaccaaacgcttcatgaaagatccacaggaagtgcgtattcagtcaagcctgaccacgcgtcctgatatcagccagagctactggaccgcttacggtcgtaaaacagacgcactggttcgcttcctggaagcagaagactttgatgctgccatcatcttcgtgcgtaccaaaaacgcaaccatggaagtggcagaagcgctggaacgtagtggctataacagcgccgcgctgaacggtgacatgaaccaggctctgcgtgagcagacgcttgagcgcctgaaagatggtcgtctcgacattctgattgcaaccgacgttgcggcccgtggcctggacgttgagcgcatcagcctggttgttaactacgacatcccgatggactcagaatcttacgttcaccgtatcggccgtaccggtcgtgctggtcgtgctggccgtgcgctgctgttcgttgagaaccgcgaacgccgtctgctgcgtaacatcgaacgtaccatgaagctgaccattcctgaggtagaactgcctaacgcagaactgctgggtgagcgtcgtctggctaagtttgctgctaaagttcagcagcagctggaaagcagcgatctggatcagtaccgtgctctgctggctaaaatgcagccagaagacgaaatggatctggaaacactggcagccgcactgctgaagatggcacagggcgaacgtcctctgattctgccaccagaagcaccgcgtccggcacgtcgcgaataccgcgatcgtgacgagcgtgatggccgtcgtgacagccgtgaagcgcgtggcgattctcgtgctccgcgtgaaaaccgcgaaagccgtgatggcgatcgtccacgtcgcgaacgtcgtgacgttggcgaaatgcagctgtaccgcatcgaagtaggccgcgatgatggtgttgaagttcgtcacatcgttggcgctatcgctaacgaaggcgacatcagcagccgttacatcggtaacatcaagctgttcggtacccactcgactatcgagctgccgaaaggcatgccaggcgatgtgctgcagcactttacccgtacccgtattctgaacaagccgatgaatatgcagttactgggtgatgcacagccgaacgaaggccgtggtgaccgtcgtccagctggtgctggcggtgagcgtcgcagcggtccaggtgcaggcggtccgggcgcagctaaccgtgaaggtggtcgtcgcttctcttctgaacgccgtgaaggtggtcgtgaaggcggcggacgtactttcaaccgtgaaggtagccgtggtccacgtcgtgaagagggcgcagccgccgctccacgtcgtcgtgatgcataacgacttagcgtcgtaacaaaaagggaagccaatggcttccctttttttatgcctgtcaggcaccgccgctgatcatcacacgctcgccgctgacccaggcggactcttcagaggccagaaacagcgcaacctgcgccacatcttccggcagaccaaagcgtcccagcggcgtggctgccagcagttgcgctttgagctgtgggctcatcctcttcgcggccagtaatccctccgtcagaatcatgcctggtgccagggcgttaacccggatgttctttgcgcccagctcgcgcgccagtccctgggtcagggtatccactgcgcctttggttgccgcccagagcacggaacctggcgtgctgtttttactgttcagggcgctgagattaataatgctgccgccgtgcgccgggaagtgatgaatcgcctgctgacagaccatcagcgtacccagcaggttaacgttaatctgctgctgcatctcctccagcgtcagcgccgcaaactcgccgtgatgaaagctgcccgcattgttcaccacaatgtcgggcgcgccgaagcactctgcggtggtggcgaagagccgttccacatcccgtaggagagagatatctgcctgtaccgccacggcttcactgcccagggtgacgatatcgctgaccacgtcagccgctcccacttcatcctgacgataattgaccacgacgcgggcgccagccgcggcaaaagcgatggcaatcgccgcaccaatgccttttgaggcgcctgttaccagcgcaattttattctgcagtgccttcattatgttgttctccgccgtaatgattgcgtcgaaagactatgcgcgctggtgccgaaaagcgggtagtgcaatcctgcaagcttcttgcacgatcctgcaaaagtaacgcaacgggccaggtattccgctcagcgtcaggtaatatcagcacagatagcgggaggggagaacacagtgacagagagtgagaagtggcaggggctggcgcagttaattgcccgtcatgctccggaggatgggcggcattccagcgccatagattgcctgttttttggccgggtttcagcaccgactgagccaatgcactttgctcaatgggccagttttgccctggtggcacagggcggtaaggcgctgcatatcggtgatgaggtgctgcactatggtccgggcgatctgctgctggtgacgctggatatgccggtgcgcgcctgcgtcaccgtcgccacgccggaaaaacccaatctggggattggtattgccatcaatgaatcccggctgatgcgctacctcgaacagtttcccccgacgctgccgctggtgacaccagacagtgaacgcggcgtcaccgtgcataaggtctcacctttgctggtggatgcggttatccggctggtacgcctgcttgaccatcctgaggacattgaggcgctggccccgctcattgagcaggagattttctatcggctgctgaccgggccggaaggttcgcgcatcctgaatatggcgctggctgagcggccgggcaaccgggtcgcgcaggctgcccgctggctgcgggaaaattttcatcagccgctgaagatcgatcggctcgccagcagtgtcggcatgagcatctcttcgctgcatcatcacttcaaagccgtgacggctatgacgccgatgcaataccagaaacaactgcggctgaatgaggcgcgacgtttgatgatggtggaaaagctggatgccggtacggcaggctatcgggtggggtatcagagcgcgtcacagttcagccgggagtatcgccgcctgtatgggcaatctccggccagggatagtcgtcaactggcggtgagcccggacagattgcgcccaccgcagaactgattacaggctgttagccgcttccatcgcaatggcgaaggagcgcaggcgcgcttcggaatcaaaaatctggccattgaccataatttcatccgcctgggtttcacgcatcagcgaggccagcccatgacgcactttgtccgtatcgccgaccagcgacatgctgagcgcctgctgtacgccatactgttctgatggcgaccagaggttatccatgttttcaaccggtgccggtaacgggcccggtttgccgcggcgcaggttgataaactgctgctgctgcgaggtaaacaggaagcgcgcatcacgctcactgtctgcggcgatcacgttaatgcagaccatggcataaggcttgtcgagacgcgccgatggctggaagttttcgcggtagacgtgcagcgcctgaaagagctggtcaggggcaaaatgggaggcaaacgcaaacggcaggcccattttcgctgaaagctgtgcgctgtagagactggagccgagcagccagaccggaatctgcaggcccagaccaggtaccggctgcactggcggctgcgcatccgcttcggcatcgaaccagctaatcagttcagccacatcctcggggaacgtgtcgatgtgcatgttggcctgatgacggcgcagtgccatcatggtgcgctggtcagaaacctggcgcgcgacctaagccgagatcgatacggccaggatagagagaggccagcgtaccaaactgctcggcgatcaccagcggcgcatggttaggcaacataatgccgccggagcccagcttcagagtctcggtattcgccgccagatagccaatcagcacggaggtggctgcgctggcaatccccgtcatgttgtgatgttcagccagccagtagcgttgatagcccagtttttcagcctgacgcgccagcgccagcgaattatggaacgcatcccgagcggtcgcgccctgtggaatcggcgcgagatccagcacggacaggcgaagaggttttttatcagacatgactactcccgttgtatggcgcaggcgttaagttaaggcctgcaccatttagtattacgcatcattccttatattaaaactgctaacctcagcaggaatatagccggtatgtgcttttattcaggatgccagcgtcatgcccgccagtttgcgccagtaaccgttacaatcactgccttttgcgaccattagcggagcctgaccgttttcattggcgcggaaacggtcgatctctgccagcgtcgtcacatcctgcggtgagagccgtatgcaatcgacctggccgtgcataccagccagatcgttacccaggttatagcagtagccgctcatggtctgaatgccattgaggacgaacacctgctgcccctcctgggagttgacgcgccggcctgtcggatagttgatacagcaggtttcgcagtcatctttcgcgcggttttccgagcgggcggtgaagcagcgcgctgagagcgccagcggcagatgaccgtagcccagcacctccacctcaaactgctgccggataccccgcgtctcgcactgctccagcagctgtagcagccagtcacgtgacatctccaccggcatacaccagcgcgtcatgccctctttgaccagcagctgcagcgtgtcggcgttataaacattgagcgtcggacccgcgacaaagggcagatgacgctcagcggccatgttaaccgtgccgatatcattggcttcaatcaggaactcaccgttctctacgtaacgctgcagctctttcagctcagagggcgattgcagcagcgccagcgtgctcagcaccacctgtttgccgctggccgcgagttcacgagccagcgccatccagcgggcatagggcgtggcgcgacgtttactgcacaccgcttcgccgaggtagataatatccgcgctactgcgggcagcctgctggtaaaaatctcccagcgtatcggtcggccagtaccagagcaccggcccaagggcatattgcatcatgactccttattgccattcacggtgataagcacccagcgtggtttgcgaaccttctgagagatcgcccagcgtctgcatccactgtggtgcgacttcaaactgttccggctgcgccttgcagcgatcaattgcctgacgccagacgcgcgccacgtcagcgacataggcagggctgcgctgacggccttcgattttcaccgaggcgatgcctgcccgcagtagttccggcagcagctccagcgtgttcagactggtgggctcctcgagcacgtgataacgcttgtcgttaaccatatagcgtcctttgcaaagtgtcggataacccgcgctttcgtccggggcgtagcgatcgatcaacacttcattaagacgtgactccatgccctgcggcgtctgctgccagcgcacaaacttagccggggagcaggcaccggcgctgttaggcgattcaccggtcagccaggaagagaggtagcagcggccttccgccatgatgcacaggctgccaaaggcgaatacctccagcggcaccggtgtgctgcgagccagctgtttaacctggtgaatcgacaggacgcgcggcagcaccacacgctgcagattgaagtggcgatggtaaaagcgaatcgcctccagattggttgccgaagcctgtacagaaagatgacgttcaacctggggatagcgcgtcgcggcatactccagcgtggcgatatccgccaggatcagcgcgtcagctccgttttgcgccgccacatcaatcgcccgctgccagcgacccatgccatccggatgggcaaaggtgttgatcgcaacatgcagtttgcgacgatgctgatgaagatagcgcgcggcttcagccagttttttatcggtgaaattcagacccgcaaaatgacgggcattggtgtcatctttcagccccacatacaccgcatcagcgccattctctacagcggtgcgcactgcgggtaagtttcctgccgggcagagcagttccatagatattcctctcaacatgcagatgggcgtcgagtctaggcatctggtccgggcagcgtgttgatttggggcagtgaaattcaaattcatccgcccggcggcgctttttttacctgcatggcagcggtttttattgatctcagaggaggcgcgcagaaaaggatatggcaatatacgtaaaattttctgaagggagtgacgaaagtgttagagcggatacatgcccattgtgtgaaaaacggtcctaaaatcttagggttacccgctgcgttcaccccattcccggtcaaaaagttgcttctgcaacaactcttaaactggcaatttcgtcatgctttggctgaaggtgagttagactttctggatggtcgcctgctgggtattgaaattgccgatctcaatctgcaatggataaccacgctgcaggacggccgactggcggtattgcaacagtccgaagcggatgtctggtttcggggcaatgccaatgatctgttgctggtggcagcacgtaaagcagatcccgacatgctgttctttcaacgccggctggtgattgaaggtgacactgaactgggacttgaggtgaagaacgtaatggatgctattgaacccgaggctatgcccaccgcgttacgcacggcaattgagcagatggcggcatttgtcgacgccggcatgaaacaggacgcgaaggccgctcaggcgcgcgcaggtgctacatgttgattcgtagtgaaattggcgtggatgccgcaggcatcgacgcgctgctcagacgctgcttcagtacctctgcagaggcggaaactgactcaggcgctgcgtgaagatggcttgctgaccttaggcgtggtcgcgacggatgacgagggacaggtgctgggttatgccgcattcagtccggtcagcgttcagggtgaagatcgcggctgggttgggctggcaccgctggccgtcgatgagacgctgcgcggtcagggtattgccagcaagctgatctatgaggggctggatacgctcaatgaatttggctacagcgcggtagtggtgctgggcgatccggcgctgttcaaccgttttggttttgaaccggcggcacgccacggcctgcgcagccgctggccgggtacagaggcaacgttccaggtctaccgtctggccgataatgcgtatgacggggcggaagggcagatcgactacgccgaaccctttaatcgccagccgtaatacccagccagctcaccagacagccgggctggcccgccaccagcagtaatttctgctggcgggtcagttgcttgacctgatactccagcctggaggcgctggcgcgatcgcccgcgtcacagtgaaacaccaggtccagcggccctttgccgcgcagcgcgcgggcgccgcgtccgctctggtgctgagcgacccggcgcaccacatccgtggtgataccggtgtacaggctccctttcgccgtacggacgatgtagagttgccactgctgactcatcgcaatcatttcccaaaaaaaggtgccgggcagtttagcgcgcttcactctccggtgcaccgccaggagtttatcttgtccgatcacgcccatctggttcgctatctgagaaagcagcatgtgctttcactctgctgtaccgccgacgatcaactgtggtgcgctaactgctactacgtctttgacgagacgcgcatggtcttctggatcatgacggaacccgatacccgccacggtgagttaatggtgcagaatccgcaggttgcgggcaccgtcaatggccagcccagaagtgtgctgctgattaaaggggtgcagtatcgtggccatgccaaacggctggaggagacaacagagcagatcgccagagccgcttaccagaaacgttttccggtctcacgcaaagtgtcggcaccgctgtgggagattgtgctggatgaagtgaagatgacggataatgcgctgggattcggcaagaaaattgcctggcagcgggagcaatagaaacgcccttttcagcagaaaagggcgtcgcggcttacagcgcttcgaggatccgcagggattcacgattaaaggccggtaaatcggccggggtgcggctggtgaccagcttatcgccgtctaccaccacttccttatcatggaagtcggcaccggcattgatcaggtcaatggcaacggccttaacggtagtcatcttgcgaccgcgcacgccgttagcgctaatcagcagctgtggcccgtggcagatggcaaaaattggcttgccgctggcgacaaactctttggtaaaagcgacaaaacgatcgtcgccgcgcagggcatcgggcgagtggccgccaggcaggagcagggcgtcaaattcagccgggctgacatcatcaatgctgcgatcgatggtcacttccgcttcgcctttcttgcctttaacgacattaccggcttgtttctcaatggtaaccacctcaaaaccagcgcgtttgtaaacttccgcaggtgaggtaaattctgagtcttcaaattcatcggtaattaaaaccgccactttcttgctcattttttcctccttcagcatgtggagcgcgagacgcgctttccggataacgctataagcctggtcgctgagagtgagaacgcaagccagcccgttaagatcagctatcttttaaccagtcagcagtgaaataaggatgaatctgagatgaatcgcgtattactgaccggtgccaccggcttagtcgggtcgcatctgctgcgcttactgattgaagatccacgcgtcgatgagatcatcgcgccaacccgtcggccactacccgccatggacaaggtggtgaatccggttgaggccgatctcaccgatgtcctcgggccgctgcaaagtttcgctggacacggtgttctgctgcctgggcaccacgcgtaagcaggcgggcagtaaacaggcttttatccacgttgattacaccctggtggtggacagcgggttaagcggattacgtctgggggcgaagcagatgctggtggtcagcgcgcacggggccagtcgtcactcaccgtttttatataatcgcgtcaaaggcgaaatggagaatgcgctgcgccatcagggctggccgcgcctgacgctggtgcggccttcattgctgctaggagatcgcgtgcagaagcgccggggtgaaagcctggcgggaccgctgttttcgctgctgccgggcaactggcgggcggtcagcgcgcacgacgtggcacgctgtctgcaccagcaggcttttacgccggggggcgagagcgtcaatatcattgagtctggcgaaatcccgcgccactcagcgtaactgccagataatctgattacggctgccgcgccattgcagcgtggcatccttctcctcttcgacaaaacgcccatcgatcagcacgtcgagatagaccagcacagcgcgctgcgccgcattcagctcctgcatccggtaaccggtccagagccagatatctttaccgggacacgtctgtcgcacccgtttcaccagacggcgaatgtgcggcacgttatgcggatgcagcggatcgccgccgctcagcgacaatccctggcgcggaatgcgggtgtcctgcaaatccgccagcagttgctcctccatcgcaagcgtaaagggcacgccggaatcaagccgccaggtgctctggttgtagcagccgcgacactgatgttcgcaaccagcgacaaacagcgtgcagcgggtgccggggccattaacgatatccacatcatagtagcgatggatatgcatcatcccagtggcccttcagacagatgcttcacccgacgctgcacttcctgctgtttaccagcattaaagggccgcgcatccgggctgcccagatagccgcagacccgccgggtaacggagacgcgcgccggatcgtggttgccgcacttcggacaggtgaagccgcggctggtacaggtgaactcgccgttgaagccgcactcgtagcactcatcaatcggggtattagtgccgtaatagggcacgcggtcgtagctgtaatcccagacatcctccagcgccttgaggttgtgctgcacattcgggtattcgccgtaacagatgaatccgccattcgccagcggcggatagggcgcttcaaagtcgattttgtcgtaaggattgaccttcttctcaacgtcgagatggaagctgttggtgtagtagcccttgtcggtaacgcctggcaccaggccaaactgcgccgcatcaagacggcagaagcggtcgcacagattctcgcttggcgtgctgtaaaggctgaacccatagcctgtttcagctttccagcgctcggtggcatcgcgcatgtaagcaatgatctctacccctttggcgcgcagggccgcgtcatcgtaaggatgctgatgaccgccgctgagcgcattcagggtttcatgcaggccgatatagcccagcgacagcgacgcgcggccattacggaaaataggaccgacttcatcatccgcattcagccgaaacgccacaggcgccttccatatagaggatgggcgccacgcgtgctttggtcttctccagccgcgccacccgcgtcatcaacgcccgcttagccagcagcagtcgcgcatcgagcagcgtccagaagcgcgcttcatccccgcccgcttccagtgcgatgcgcggcaggttcaggctgattaccccgatattgttgcggccctcatgaatttgctcgccgttctcttcataaacgccaaggaaactacggcagcccattggggttttaaacgagccggtgactttaaccacctgatcgtaattgaggatgtcgggatacatccgcttgctggcgcactccagcgccagttgtttgatatcgtaattaacgtcgcccgcccggcggttgacgccttcgcgaatgctgaacaccagtttagggaacaccgccgtcttgcgatttttacccagtccggccagccggttaagcagaatcgactgctgaatcagccgggccgcccagtccgtccccagaccaaaaccaaaggtgacaaacggcgtctggccgttggcagtgtgcagggtatttacctcatactccagcgactgaaaggcgtcgtagcactctttctccgtacgctggcgcgcatactgctcggcctgcgggatctgccactgctcagcaatcgccagatgccgggcatagctctgctcaacaaacggggccagcacttcatcaatacggttaatggtggtgccgccgtaaatatggctggcgacctgcgcgatgatctgcgccgtcacggcggtggcggtggcgatcgatttaggcggctcgatctcagcattgcccattttgaaaccgttggtcagcatgcctttcagatcgatcagcatgcagttgaacatcgggaagaaaggggagtagtcgagatcgtgatagtggatctcgccgcgctcgtgcgccagcaccacatcgcgcggcaggatctgctgttgtgcgtagtgttttgccacgatcccggccagcagatcgcgctgcgtcgggatcactttgctgtctttgttggcattctcgttcagcagcgccgcattggtctgatcgaccagtccgcgaatggcgtgatgtaactggctctgacgatcgcgggcgacatcgcgatcgtggcggtattcaatgtaggcgcgggccagttgagggtaaggacccgccatcagcgtctcttcaaccgcacactgaatttcacggatatccacttccggacaatcggccagccgcaatgccacgcgctcagcgacctgcgcgcaccaggccgcgtcttctacttcggctgcccgtgccgccgccaccacggcctgctcaatacgctgcgcatcaaagcctgtccggcatccatcacgcttgattaccaccgtcgccatttctctctccataaactacatataggggtcgaaaggattctattcgctacatgtagtgattgctgagaattattgcgatcagatttgacctgaaacaaggaagcctcaacccgctggaaaactctggctgatgtaaaaaatcgggtgctggttcaggtttcctgcaggatccactggcggattggcgagcagcaactttaatcaacgtttctgccctgtcaaaacgttgacgttacaaggatgcccgccaatgtggttaccccgttctctgctcctgctctcggccctcagcccaatcgccctggccagtccgctgccgctgatgccctggccgcaacaggtggaacagcctgccagcggcggcacgcttatcctgacgccgcagctgacgctgcaaatctctggcgatcatctggcgggtgctgaagcgcgctggctggagcggatcagtaatcagaccggctggccgctgttgcccgccacccagccgatagcagcaccgactatccgcatcgtcattgcgaaagcggtggatccgcagccgctgcctgatagcgatgagagctatcagttgcaggtcgatggcgacggcgtcctgttaaccgcgcccagccgtttcggcgcgatgcgcggcatggaaaccctgctgcagctgataaaaaatggcgcacagggcacgaccattccttacgtcaccatccacgatcatccgcgctttccgtggcgcggcgtgctgatcgacacggcgcgtcactttatgccggtggagacgcttaaacgtcagatcgacggcatcgccgccgcgcgcatgaacgtctttcactggcatcttactgacgatcagggctggcgcttcgcctccagccactatccccagctgcagcagaaagccagcgatggcaactattacagccagcagcagatgcgggagatcgtgaaatatgccaccgatcgcggggtgcgtgtggtgccggagctggatatgccgggacatgcttccgcgctggcggtggcgatgccagagctgattagcgcacccggcccctggcagatggagcgcggctggggcgtctttaaaccgctgctcgatcccagcaacgaacaggtttatcaggtgatcgacacgctggtgggtgagatggcggcgatcttccccgatccctggctgcacattggcggcgatgaggtggatccgacacagtggaacgactcgcccgcgattcagcagtttatgcgcgaccacgatctgaaagatgcccatgcgcttcaggcgtatttcaatcagcgggtagagaagatcctggaagcccatcaccgtcagatggtgggctgggatgagattgcccatcccgatctgccgcgcagcattctgatccagtcgtggcagggccaggatgcgctgagcgcgctggcaaaagagaactaccgcggcatcctctccaccggtttctacctcgatcagcctcagcctgccagctatcactaccgcaatgaggtcacgccacagggcctcaacggccaggatcgtctgcggccaggcgatcaggcgcagagctggtcattcaccatgccgcggctgaaaggcagcccggtaaagggcagctttacgctgatacagggagaaccaggctggcgcggttttatcgacttcgatggcaaagcccgccggatggtcggtcagatcaactggctctcgactcagcaggtgcggtttagcgtggatagctggatggggccgttccagccggtgttcacgctgcaacagaacgccctcaaaggttatgcagaggtaggcaacgtgcgttatcccaccagcggtcaacggctggcgcagccgcctgcgggcatcgcgcccgcgctgcccacacctgagcaggtgcagcaaaatctgctgggtggcgaggcggcgctgtgggcggaaaacatcaacagccagattattgataccaaactgtggccgcgcgcctttgtggtggctgagcggttatggtcggcacaggatgtcaccaataccgactcgatgtattcgcggctggcggcgatggatcgctggagcagcgtgtcggtcggaacgctgcaacacgcgcagacggagcagcagatgatgcggctggccagtgggcatgacatcgccccactgcgggtactggccgaggtgctggaaccggcgcaatactacacgcgccagcatctcaagtttcaggcgggccattacgactaccatgaacccctgaaccggctggcagatgtactgcccgctgagagtgaggcggtacgtcagctggagcagcaggtcgccgtgttaatcgccaatcgtaataatccggctgccgcctctgcggttcgcgcgccgctgcagcgctggcaggctaacaccagcgcggtgctgccgatcattaacgccagtgcaacgctgaagccgctggcacagagcgtgcagcagatcgaggtgctgagcaccatgggcctcgcgctggttaatgcttacgttcgtaatcaggcatttggtgccagtgaagtggcggagatgcgtgcgacactggatgccgccgcagaggtacaggatgaaacagtgattgcgctggtcaggccgctggagacgctgctgcgcgcctttcagtaaacgctgcggccggataaaccggccatagcgtcctcaggccgggccgctgaccgagtggcggcgcaccagggtcgggctgaacatgtgggtcacttccggcagcggctgattgttggccagcgcaagcgcaagctgggccgcctgctgcgccatggtgacaatcggatagcggatggtggtgaggcgcggtcgcacatagcgcgaaaccagcacatcatcgaagccgatcagcgacatctcttccggcacccgaacgccgttatcgctcagcaccgccagcgcgccggcggccattgagtcgttgtagcaggcgacggcggtgaaattcttgccgcgacccagcagttccgtcatcgcctgctcaccgcccacttcatctggttcaccccaggtgaccagccgatcgctgcacggcagaccgtgttctttcagcgcatcgtagtaaccctgcaggcgatcttctgcatcggagatagtgtgggtcgagcagataaaggcgatattctggtggccaagctggatcagatgacgggtcgccagccaggcgccgtagcggtcgtcgagcgcgatacagcgcttttcaaagccttttatcagccggttcagcagcaccatgccaggcacctgcttcatcagcacttccagctctgcatcggggattttcttggcgtgaaccaccagcgccgcgcagcggtgacgcatcagttgttcaatcgcctgccgctctttttgctcattatggtaaccgttaccaatcagcaaaaagttaccggtgtcacctgcaacctcatccacggctttaaccattgcgccaaaaaagggatcggagacgtcaccgacaatcaggccgagcgtttcggtcgattgctgcgccagcgcgcgtgcgttggcgttcgggtgatactgaagctgctccatcgcctgacctacggcctgtcgggagctgtcgctggctttgggagaattattgattacacgggagactgtggcgacagaaacgccagccagtcgcgcaacatcctttatggtagccatgcgttgacctgctttggggaaaacgtttacacatcgcatcagtgttacggaaaagggcggacacatcaacccgacagaatgccagcgtcgtcgcaaaaaggggtaaaaacggtcactgctgcacgtcttctgctgaggcgtcgcaccatgctatgctcaatctcccacctggctaccgtgaaaaacaacgatgaaaaccaaagtgccacatctggcgcactggggcgcctttaccgccgtcactgaaaacgatcgcctgattggctgcgaacccttcttcgccgatgccgatccgtcaccgatgatccacaccattcctgaactggtctattccgacaaacgcattcgtcagccgatggtgcggcgctcgtggctgaagtcacgcgaaaaaagcgatcgtacgctgcgtggccgggaagattttgttgccgtcgactgggaaaccgcgctggatctggtggcggaggagaatcgccgcattcgcgagcgctatggcgcatcgggcattttcaacggttcctacggctggtcatcggccggacgtgttaaccatgcccgcaccctgattcgtcgcttctactttcagggcggcggcggcgttgatcagcagggtaactacagctggggcgccgcgcagttcttcctgccctatgtgattggcacctacatgccgctgaccgggcgcgtcaccgaatggccgcaggtggtggaacatgccgaaatttttgtcgcctttggtgggctggcgctgaaaaacgcccaggtcgcctcggggggcgcagggcagcacagcctgaaaccggcgctgatgcagctggcggccaaaggcacgccggtgatcaatatcagcccgatgcgcgatgactgcccggaatttgtcaacgccgagtggattccgattcgccccaacaccgacgtggcgctgatgctggcgctgggtcatgagatcacccagcgcggcgcggttgacgaagcgtttctcgccagccactgcaccggctggccgcagctgcgcgcctatctgctgggcgaaaccgacggcgtggcgaaaaccgccggctgggccagccgtatcaccggcatcccggccgatcgcattgtacagctggcgcagcagctcacaggcaagcgcagctttattacctgctcctattccgttcagcgcgcccatcgcggcgagcagccttactggatgatgattgcgctgtcgtcgatgctcggccagccaggcctgccaggcgcaggtttctcttttggtcacggttcgatgaacagcgtcggcaacccgcgccaggaaggtccggctccgatgatgagcaccggcccgaatccttccgggctgtcgattccggtggcgcggatcagcgatatgctgctcaatcccggccagccttaccgctttcagggcgaaaccctgcactatcccgacattcacatggtgcactgggcgggcggcaatcctttccatcatcatcagcagctcaaccggctggtagagggctggcagcggcccgatacggtcgtggtgcaggatatcgtctggacgcccgccgcgcagatggcggacatcgtgctgcccgcgaccaccacgctggagcgcaatgacatcggcggctcctcacgcgaccgctttgtgctggcgatgcatcaggcgattaaaccgcagcatcaggcgcgcaacgacttcgatatttttgctgacctggcggagcgcctcggctaccgcgataccttcaccgaagggcgcaacgagatgcagtggatcgcccatctttatcagcagtgtgcgacggcgcatcagcgtaaaggcatcgatttcccgtcgtttgaggagttctggcagcgcggctttgtggagatccccgaagggggcaaaccctatcagtttatggaggaattccgtgccgatccgcaggccaatccgattaaaaccgccagcggcaaaatcgagctcttcagccagaccattgcggactaccagctggacgatttcgccggccatccggaatggcgtgaaccgcaggagtggctcggttcgccggtcagccgcgactatccgctgcacatgatctcgattcagccttccgaccggttacacagtcagctggatgctacagaaacggtgcagggcaataaaaccgccggacacgaaacgctctacatgcatccgcaggatgcggccgcgcgcgggctggtagagggcgacgagatagaggtgagcaacgcacgcggcgtgatgctggcgggcgtgcggatcaccgatggcgtgacgcagggcgtagtgattatcgccaccggcgcctggtttgatcccggctttggcaaggcgtggcagccgcacgatcgcgcgggtaaccccaacgtgctgacgctcgacatcggcacctcgtcgctgacgcaggggccaaacgccatgagctgcctggtggaaatcaaaaaacatcaggattgcacaatagcgtaaggatctcatggctggttacattttgccggtaactgttgcgtttgagatatggcagccgatcgatccctcttgctacattcagggtcccagaggtattgatgggtgaacatcaatagattttcttgattacaccaacctgcgcagatgcgcaggtttttttttgccagaaatcggctgccgataacgaactgatacacagttttcctgttatacggccagcgctttctttataactgctggcaccagcccctttctctttattttgcgcagcggaatgccatgccccggattaaaaaactactgggaaaagaccagataaaagcgccgtttaacccttttcgtttccgactgatctgcctgggtgtcacgacctgtctggtggtgctgctggcgcgcgtcgcggacctgcagttcctgaatcagccgatgctggagcacgaagcggatcagcgatcgctgcgtaccgtgacgctgccgaccagtcgcggcacgctgctggatcgtaacggtgaagcgctggcgctcagcgtcccgtcgcgcgacgtgattgccgatccgcagcgcgtgctggagagcaaccccgattttaccagtgccaaatgggcctatctggcggcggcgctcaacacccgtcccgaagagctggcggcgcagatcaccgccaacccgaaacgtcgcttcctctatctggggcgtaaagtcgagctgggcattgccaaagatattaaagagctgaagctgaaaggcatcagcgaagtctatgatgacagccgtttctatccgatgagcgaagcctctgcgccgctgatcggcatcgtcggggcggataatgtcggcctgaacggactggaaaagggctttgataaagtattgcagggcgagccgggcaaagaggtctatcggcaggatgccgcaggcaatatcatcgcgatgatcaactatcagccgccgacccagccgccgacggtacagctcagcatcgacaaatatgaccagtacacgctctacagcaaactgcgcgacggcgtactgatcaacaaggcggactcgggtgcggccgtgctggtgaaaatcgacaccggcgagattctggcgatggcctcctatccctcgttcaaccccaacaactatgaaggggcaacgcccgcgcagatgcgtaactctgccatcaatgacagctacgaaccgggatcaaccgtcaaaccgttagtggtgatggaagcgctggagcgccacctggtgcgcccggattcggtgatcgacaccacgccttacagcgttaacggccacctgatccgcgacgtcggccactggccgcgcctgaccatgaccggcattctgcaaaaatcgagcgacatcggcgtgtcacacctcgcgctggcgatgcccgccgaagcgctggtcaacacctatcatgcgttcggccttggcaaaccgaccggcttagggctgaccggcgaaagcgtcggctactttccgttgcaccgcacccgctgggcagatatcgagcgggccaccttctcctttggctatggcctgcgtgtgacgccgctgcagattgcccgcgaatacgccacgctcggctcctatggcatttaccgtccgctgtcgatcacccgcgttacgccaccggtcatgggacgccaggtcgccaacccggaaacggtgaaagaggtggtgcacatgctggagagtgacgtcctgccgggcggaaccgggctgaaagctgcggtgccgggctaccgtctggcaaccaaaaccggtacggcggaaaaaatgggcaccagcggcaagtatgatggcggctacgtcaactacaccgccggtctcgctcctgccagccatcctgaagtggcgctggtggtgatgatcaaccatccgacggcgggcgatcacttcggtggctcggttgctgcaccggtgttcggcaatatcatggggccggtactgaaacacatgaatattgcaccggatgccatctacaccaaaccggcggccactccttcagataaatcttagataaatcagagtgtaagcgaggcgtgaaggatattcacacctcgttgcacttccccgaattcggttgcgttttcctgctgtctccgcgcggtcaatcagtgcgaggatagcagtcccagaggtattgatgggtgtgaaaacgacactgcttcggcagtgagaccctgttattacaccaacccacgcagatgcgtgggttttttttgcctgcttgcctgagcctgccgttaccgctgtaaaaacccccgctaaatcaacatcgttcttaacgaaaccctgacagtttgccgatagaaaggcgcatcgcctttcactgataatggccgccgtgaagcctggcggttttttgcccgccgccgctcactgccgcattccgcacgttccgggatttctttttctgcttatctgaagagttcgacgatgactcacctttctcgccccgcgcgttcctttgggcttaaatggctgctcctgttgctggtgatggcgattatcgctggggttatctggcgtctgctggcggcgggtcacgggccgggcgaggggatgccgtcgggcagaccgggtgcgcatggcatgatgggcggaggggcgacgctggttcacagcggtgtcgccagcacggcggatgtgccggtgtggctgaatgcgctcggcacggtcatccccaacgccagcgtcacggtgaccagccgcgttgacggccagctggagcaggttttctttaccgaggggcagaaagtcagcgccgggcagctgctggcgcagatcgatccgcgcagctttcaggccacgctgaaccagtatcagggcgaactcagtgaaaaccaggcgctgctgaaaagtgcggagctgacgctggcgcgctaccgcaaactggcggcgcaggatgcactggcgcgtcaggatctggacagccagattgccactgtcgggcagtatcgcggtgccgtcgccgccgatcaggcgcagatcgccagtgccagactcagcattgaatatgcccggatcaccgctccgatcagcgggcgcgtcggcctgcgtcaggtcgatcccggcaacatggttcagagtgccagcagcaccggcctggtgactattacccagatgcagcccgccgccgtgacctttagcgtgccgcaaagcgaaatcccgacgctggtcagcgtgctgcatcaggggcagagcctgcccgccacgctgtatgatcaggacaaccagcatcagctcggcagcggcgaggtgaagttcatcagcaaccagatcgacaccgccaccggcaccgtggcgctgaaagcggtgttcgccaaccaggatgagtcgctgtttgccaatcagtttgtgaatctgcggctgcagacccgggtgctgaaaggcgcgacggtgatcccggcccaggcgctgcagctgagcagcgacggcagttttgtctttgtgatcaatcaggatcacagcgtcacgcgcaaagcggtcaccaccggtcccgctttcggagacgatcagcaggcgatcctcagcggcgtttcgccgggcgatcggctggtgacggaagggatcgatcgtctgaccagcggcagcaaagtgtcgctggccgatgagaggcccgccgctgcgggtgctgtgtcgaaatgaacccgtcgcgcctgtttattctgcgtccggtcgccaccattctgctgatggtcggcgtgctgatcgccggcatttttgcctggaaattcctctcaacctcggcgctgccgcaggtcgactatccgatcattcaggtcaccacgctctatccgggtgccagcccggatgtgatggcgtcgtcggtcacctcaccgctggagcgccagttagggcagatggcggggctgagccagatgagctccaccagcgccagcggctcgtcgatcattaccctgaagttcagcctcgatctgtcgctggatatcgccgagcaggaggtgcaggcggcgatcaatgcggcgaataacctgctgcccgacgacctgcccaatccgccgacctacaaaaaggtcaatccggcggacagcgcggtggtgacgctggcggcgagctccagcacgctgccgttgaccgcggtgcaggatctggtcaatacccgggtggcgctgaagctgtcgcagatctccggcgtcgggatggtgacgctggcgggcggccaccagccggcgattcgggtgcagatgaatcctcaggcgctggcggcgcatcatctgacgctggaggcggtaaatacgctgattggcaacagcaacgtcaatggctccaaaggcggctttgacggtaaatatcattcggtgaccattgacgccaacgaccagctgcgcaccgcaaccgagtacgggaacctgatcctcagctatgagaatggcgcggcgctgcgcctgaaagatatcgcccacattgaacagggtccggaaaacagcttccagtcggcgtgggccaacaaccagcccgcgattgttatcagcgtgcagcgtcagccgggcgcgaacgtgatccaggtggtggacaatatcaaggcgcagctccccgcgctgcaggcggcgctgccggagggggtgaagatgacgattctctccgatcgcacccagaccattcgcgcctcgatcagcgacgttcagtttgaactgatgctgtcgattgcgctggtggtgatggtgactttcctgttcctgcgcaacgtggccgccacgctgattccgagcgtggcagtgccgctgtcgctggtcggcacctttggtgtgatgtatctggcgggcttcagcctgaataatctgtcgctgatggcgctgactatcgccaccggttttgtcattgatgacgccatcgtggtggtcgagaacatctcccggcggctggagcagggtgagtcgccgatggaagccgcgctgaaaggctcccggcagattggcttcaccattatctcgctgaccttttccctgattgcggtgctgatcccgctgctgtttatgggcgatgtagtcgggcgactgttccgggagtttgcgattaccctggcggtggcgattctggtgtcaatgctggtatcgctgaccctgacaccgatgctgtgcgcgtatctgctgcgccacattccgccagaacagcagtcgacgtttgcccgcaagggcggcgaactgtttgatgccctggtgcgcggttatgatcggctgctgaccgtggtactgaaccatcagaaactgacgctgctggtggcgctggccaccttcgggctgacggcgctgctctacataatggtgccgaaaggcttcttcccgacccaggataccgggctgattcagggcattaccgtcgcctcacaggacgtctcgtttaacgccatggcaacgcggcagcaggcgttgtcggcgcggatcctgaaaaacccggcggtggagagcgtctcatcgacgatcggcatcgacggcaccaacaccagccttaacagcgggcggttgcagatcaacctgaagccgtttggctcccgcgatctcagcgccagcgaggtgatcagccagctgaaacaggcgaccgccgatgtgccgggcatccggctctatctgcaaccggcgcaggatctcaccgtcaacgatcaggtctcgccgagtcagtatcagttcaccctcgatgatgccgacagtgaaaatctggtcagcgagtcgccgaaactggtggcggcattgcagcagcggcccgagtttaatggcgtggtgagtaacctgcaggatcaggggcgcgtctcttacgttgagctgaaccgcgataaagcggcgcgcttcggcattactgcctcggacgtggacaccgcgctctataacgcctttggtcagcggctggtctcgaccatcttcacccagtcgaatcagtatcgggtggtgctggaagtggctccggcataccagcagggtccggcatcgtttgatgatgtctggctgcaatcgtccggcagcagcagtttcggcgtcgtcatccaccagcacgacttcatcaacgtcaacgtcttcgtcaacatctacgtcttcgtcgacgtccacttcagcctctgacaccagcgccagcaccaccagcagcggcatggtcaaactcactgctatcgccaccatccaccggcgcaccggttcgctgatgcatatgcggctgaatcagttcccggcggtgatgatctccttcaaccttaatccgggctactcgctggaggatggacaacgggcgatcgcggaagtacggcagcagctacatctgccggagagcaccacactgcgttatcagggggaaacctcggcgtttcagagcgccaccggcaacacgctgtggctgattctggcggcgctgatcaccatgtatgtggtgctcggcatcctctacgaaagctttatccatccggtgaccatcctctctacgctgccgtcggcggcggtgggtgcgttgctaacgctgctgctggcgggcaccgaattcagcctgattgcgctgattggggtgatactgctgatcggcatcgtgaaaaagaacgccatcatgatgatcgacttcgcgctggaggcggaacaccatcagcaactcagcgcgcgcgacgcgattcatcaggcctgcctgctgcgcttccgcccgattctgatgacgacgatggcggcgctgctgggtgcgctgccactgatgctggcctccggctccggggcagagctgcgtcagccgctggggctggtgattgtcggcgggctgattgtcagtcaggtgctgacactcttctccacgccggtcatctacctcctgtttgatgggctggcgcagcgcggtaacgcttgggtgaaacgccgtcagcagcgggcgcggagcgggcaatgaatctgacccggctgtttatctttcgtccggtggcgacgctgctgctgacgctggcgatcctgctgctgggcgcgctgggctaccggctgctgccggtagcaccgctgccgcaggtcgattttcctaccatcatggtcagcgccagcctggcaggcgccagcccggaaaccatggcggcgacggtcgctacgccgctggaacgttcgctggggcagattgccggtatcagtgagatgacctccagcagctcgcagggctccagcagcatcatcctgcagtttgaactggaccgcgatatcaatggcgcggcgcgcgacgttcaggcggcaatcaacgcagcgcgcagcctgctgcccagcgcaatggcctcgctgccgacctatcgcaaagccaacccgtcagacgcgccaatagtgatgctggcgctgacctctgccacccgcacgccaggcgagctctacgatctggcggagagcaaaatcgaacaggcgatggggcaggtacagggcgtcggcgaagtctcgctgatgggcagcgccttaccggcggtgcggattgatctgcagccgctgaagctgacccattacggcatctcgctggagacggtgcgtgccgccgtcgccaacagcactaccaatctgcctaaagggatcttacagggcagtgaccagtcgtggctggtggacagcaacggccagctggagaaggcggccagctaccgcaatctgatcatcacttatcagcagggcaacgcggtgcgcttgcgtgacgtcgccacggtctatgactcggtggaagatcgctatcaggcagggtttctgaatgccacaccggcggtgatgatcggtatcaaacgtcaggcgggtgccaacatgctggaaaccatcgacgcgataaaagcgcagttgccgcagctggaaaagagtctgcccgctgacagccagctgaaggtggtggttgaccgttcgcctggcgtgcgcgcctcactgtatgacaccgaagagacgctgctgatcgcggtgctgctggtgattgcggtggtgtttatttttctgcgtaatctgcaggcggtgatcattccggcgctggcactgccggtgtcgctgatcggcacctgcgcggtgatgtatctgctgggatacagcctggataacctgtcgctgatggcgctgattatcgccaccggcttcgtggtggatgatgcgattgtggtgctggagaacatcacccgtcacattgagcgcgggctgagcccgttgcgggcggcgctgcgcggggcgcaggaggtgagcttcaccgtgctgtcgatgaccgtgtcgctgatcgcggtgttcatcccgatcctgctgatgggcagcattgtcgggcggctgttccgcgaatttgccgtgacgctcaccgtgtcgctgctgatctcgctgtttgtttcgctgagcctgacgccgatgctctgcgcccgcctgctgaaaccaaagccgcccgtcagccagcggccgcatccgctttatcagttgattgaaaaccagctgaatcgcctgctggccgcctacgggcgcgggctggcctgggtgatgcgccatcagaaactgacgctgctcagcctgctgctgaccgtactactgaatgtttttctcttcgtcgtggtgcagaagggcttcttccccaatcaggataccgggctgctgatgggtgcgctgcgcgccgatcagaacatctcgttccaggcgatgaagccgaaaatgctgatgttcacgcagatcattcagcaagacccggcggtagagagtgtgatgtcgtcgatgggcagcgggatgtttggctcccgtaacagcgccaacttctttgtgcggcttaaagattttgatcagcgcgatgcgaccgccaccgaggtggccaaccggctgacgcgcaaaaccagtcacatcgccggggcgcagatgttcctgatggcggcgcaggacctgcacattggcggacgcagcgccaacgccacatatcagtacagcctgcaggcggacgatctcgatctgctgcgcacctggacgccgaaagtgcaggcggcgctggcggcgatccctgagcttaacagcgtggactccgattcgcagaccggcggccaggagttggagctgaacatcgatcgtgatcgcgccacccgtctgggcgtcaacgtgaacatgctggatacgctgctgaacaatgcgttcagccagcggcagatcgccacgctctatcacaccctgaatcagtatcacgtggtgatgtcactgcaggatagcgacaccgccaatcccgagaccctgcagcagctttatgtgattaacgacagcggtgaccgcgtgccgctctccgcctttgcccgcttcagcggcggcaacgcgccgctgtcggtggcgcatcagggccaggccgctaccagcaccctggcgtttaatctcgacgagggggtgtcactggaacaggcgcaggaactgataaaacaggcgatggcgaagctgggcctgccatcgacccttcacgccggttttgccggcaccgccgccgccttttctcagctgaccgcgaccatgccgtggctgattctggcggcgctggcggcggtctatctcgtgctcggcgtgctctatgagagctacatccatccgctgaccattctttcgaccctgccgtcagcgggcgtcggcgcgctgttactgctgctgctgaccggcacgcagctcacggtgatcgcgctgattggcatcatcctgctgatcggcatcgtgaaaaagaacgccatcatgatgatcgatttcgccatcgacgcggagcggcggcagggcatgtcgccacagcaggcgatcacccaggcgtgcctgatgcgcttccggcccatcatgatgaccacgctggccgcctttttcggcgcgttgccgctggcgctgggcagcggcggtgatgccgatctgcgcagcccgctgggcatcgctatcgcgggcggactggcgctcagccagctgctgacgctgtttaccacgccggttgtttatctttggctcgatcgtctgggccgtgccactcaacgtcaatggcgtcgtctgcgccctacggaatcctgatccatgaaaccgcttattccctttgttgtgatgctgctgctgggcggctgtagcgtcggtcccgactatcagcgccccgagatggcgatgccggtccactataaagaggccagaggctggcagcaggcgacgccgcttgatgcgcaaagcaaaggcgaatggtgggcggtttatcacgacgccaccctgagcgggctgctgagccaggtgagcatctcgaacctgaacgtggcgaattatgccgcgcagtaccggcaggcacaggcgctggcgagtgcgtcacgcgcggcgctgtttccctcgctgggctatgacggcagcgcgacgcgcagcggcagccacgcgactgacagcagcgttcgcaccaccagcagcagccatcaggcggagctgagtgccagctgggagctggacctgtggggcaaactgcgacggacgctggaggagaaccgcgccagcgcctcggccagcgcggcggaactggccaatattaccctgagcgcccagtctgaactggcgcaggactatttccagctgcgcatcatggatcagaaaatcgcgctctatcagcagagcgttgatgcttatcagcgctatctgaaagtgattaccagccagtatcaggcgggcaccgcgtcgcgtgcgaccctggctcaggcgcagctgcaactggagagcgccagcgcctcggcgcaggattatcagtggcagcgcgcgcagatggagcacgccattgcgctgctggtcggcaaagcacccgctgaattcagcctgaccgccgcaccgctgacggccacgctgcccgcgattccggcagccctgccgggcgagctgttgcagcgccgtcctgacattgcttacgccgaacgtaacatggccgccgctaatgctgcggtgggcgtggcggtagccggttactatcccgacctgaccctgagcgccagcggtggcgtcagttcttccgtgctgcattcgctcttctcgctgccgaatcgcgtctggtcgctggggccggagctgagcggcacgctgctggattttggtgcgaccgctgcacaggtcgatcaggcacgagcgggctgggatgccagcgttgcgacctatcgtcagacggtgctgaccgcaatgcaggaggtggaagataagctggtggagctgaacacgctgcagggtgagatcgccgcgcagcagcgcgccaccgaagcagcgcagacctcggcgcgggtgacgcgtttgcagtatgaggcgggcatgattacgtatctggatgtggcgaccaccgaaaacagccgcctgagcgcgcagcagagtttgctgacgctgcagagcacgcagtgggtcagcagtgtggcgctgattgccgcgctgggcggtggctggcaggcaccctgaaggcggcgtcaggtaaccgataattctgttgtcgaaccgcgtcaaatcctgcatcgtgaggggctattttcacgatgctaaggagccggcatggttttcacactattgcgcctgatatttcgcctgttatggcgggtcgaactgcgtggcgacgtcgccgaactgcataagcagaaggtattgatcacgccgaaccatatgtcgtttctcgacggcatattgctggcgctatttttgccgattaagccggtctatgcggtctattcgaccatcagcgaaagctggtttatgcggctggttaaaccctttatcgactatgtgccgctcgatcccaccaaacccatggcgctcaaacagctggtcaggctgatcgacagtggccgtccggtggtgatcttcccggaaggacgtattaccgtcaccggctcgctgatgaagatctacagcggggcgggttttgtcgcggcgcgtttcgggcgcgaatgtggtgccgatgcgcattgaaggcgcagagtacacgccgtttggccgtctggcgggcgtgtttaaacgtcgcctgttcccgcgcatcaccctgacgattctgcccgccacccgcattccgatgccggaggcgaaacgggcgcgcgatcggcgcgtgctggccggtgagcatctgcaccatgtgatgatggaagcgcgcatggcggtgcgtccgcgtgaaaccctgtttgaggcgtttctggcggcgcgtacgcgttatggcgcgtttaagcgctgcatcgaagatgtcaatttcaaacctgacagctacaacggactgctgaagaaggcgctgggcgtgggtcgtattctggagcgctacagccagccgcgtgaagtggtaggactgctgctgcccaataccaccgtcacggcggcggcgattttcggggcatccctgcgcggacgcgttccggcgatgctcaactacacggcgggcgtgaacggcatgcgggcggcactgaccgccgcgcagatcaaaacggtcttcacgtcgcgccagttcctggacaaaggcaacctgtggcatctgccgcaggggctagatgatgtgcagtggatctatctggaagatctgaaagataccgtgaccagtaaggacaaactgtggatcgtcgcccatctgctgatgccgcatcgcgcgcagctgccccagcagccggaagacgccgcgatggtactgtttacctccggctcggaaggcaaccccaaaggggtggtgcattcgcataaaagcctgctggcgaacgtcgaacagattcgtaccatcgccgacttcaccccgcgcgaccgctttatgtcggcgctgccgctgttccatgcgtttggtctgaccgtcgggctgtttacgccgctgatgaccggcgcccaggtgttcctctatcccagcccgctgcactatcgcatcgtgccggagctggtctatgaccgcaactgcaccgtgctgtttggcacctcgaccttcctgggcaactacgcgcgctttgccgcgccctatgattttgcccgcctgcgctatgtggtggcgggggcggagaagctgcaggagaacacccgtcagctctacatggagaagtatggcattcgcattcttgaaggctacggcgtaaccgaatgcgcgccagtggtcgcgattaacgtgccgatggcggcgaaggcgcacaccgtcggacgcattctgccgggcatggattcgcggctgatgtcggtgccgggcattgagcagggcggacggctgcagctgcgcggaccgaacgtgatgaagggctatctgcgcgtcgagaatccaggcgtgctggaagtgccggtcgccgacgatggcgaaggcaatcaggaagcgggctggtatgacacgggtgatatcgtcagctttgatgacggcggtttctgccagattcaggggcgtgccaaacgctttgcgaagattgccggtgagatggtgtcgctggagatcgtcgagcagatcgctctgaaggcgtcgccggacaagcaacatgccgcctcgctgcgcccggatggtcagcgtggtgaggcgctggtgctgttcaccaccgacgctgaactggcgcgcgacagcctgcagaaagcggcccgcgagctgggtgcgccagaactggcgctggcgcgtgatatccgggtaatgaagcagttgccgcagctgggcagcggtaaacccgattacgtcacgctgaaaaaaatggcggaagaggagcaggcatgagccttgatcgtaatgcgccgctgatgtcacgcggcatgattgccgtgattatcgcccagttcttttcggccttcggcgataacgcgctgctgtttgccacgctggccgtactgaaaagccagttctatcccgactggagtcagccggtgctgcagatgctctttgtcgcggcctacattctgctggcaccgtttgtcggtcaggtggcggacagcatggcaaaagggcgggtgatgatgctcgccaacagcctgaagctgctgggcgcgctggtgatctgcttcggcttcaaccccttcctcggatataccctggtgggcgcgggcgcagcggcctactccccggctaaatatggcatcctcggtgagattacccacggtgagaagctggtgaaagccaacgggctgatggagggatcgaccatcgccgccattctgctcggctcagtggcgggcgggatgctggctgactggcatctgctggcggcgctggggatctgtgcggtgacctacggcattgccgtggtagccaacctgtttatcccgaaactgcaggcggcgcgtcctggtcagagctggcagctgggcatgatggtacgcagttttttcagtgccgccgcgctgctatggcgtgatgcggagacgcgcttctcgctgctcggcaccagcctgttctggggcgcaggcgtgacgctgcgttttctgctggtgctgtgggtgccggtggcgctgggcatcagtgacaacaccacaccaacaaccctgaatgccatggtggcgatcgggattgtgatcggggcggcggcggcggcgaagctggtgacgcttgaaacggtgcgtcgctgtatgccagccggtgtgctgattggtgtgatggtcgtcgtcttcgcgctgcagcattctctgctgaatgcctatctggtgctgatgctgattggcgcgctgggcggtttctttgtggtgccgctgaatgcactgctgcaggcgcggggcaaagagagcgtcggttcaggtaatgcgattgcggtgcagaatctgggtgagaacagcgccatgctgatcatgctggggctctatacgctggcgatcaaggcgggtgcacctgcggtggcgacgggcgtcggttttggcgtgctgtttgcgctggcgatagcgctgctgtggctgtggcgaccggctaagcgttaagcgattcaccgcctctctccgggatagccggagagaggcgggcgccctcgttaacaatagatgttaacaacgaagattagcgacgaagggcaatcgcttcgatttcgatcttcacatcttttggcagacgcgccacttcgacacaggaacgcgccgggaagtgcgcttcatgctcggtgaaaaacgcctcataagccgcattgaccgtggcgaagtcatttaaatcttttacgaacaccgtggtcttcacgatgtcgccgaccttcagacctgctgcttcaacaatcgccttcacattttccagtgactgacgcgcctgtgcggcaacgtcatccgccacctggccggtcgccggatccaccgggatctggccagaggtgatgatcatgctgcccagatcgacaccctgaacataggggccgatagcggcaggggctttttcagtactgatttcacgagacatcattgctcctttgattacgtcgtcaggcggcgatgccgccggtgttgcccattataaggtcgggcagggcgattaccagtgacccagcaccacatggcgggcgaactctttttcgcaatatttgcacttcagatgcacatcgtcggcgcgctgcttcacggcaaagctggagaagaccggctcgctgcggctgatgcagttgctgttcgggcaggtcagtacccgttcaacgtggtccggcagcgtcggggcgatcttcgccactacttcatagtcgtcgatgcggttgaccgtggcatggggcgcatagaccgccagctgattcacctgatcgtcggtgagaaaggtgttctcaatcttgatcagatctttgcggcccatctcacccgagggcagattcaggccaatggtaatccgctgatcggtttcggtcagccggaacagggagagcaatttaaagccgatctgcgccggaatatggtcgatgaccgtgccgcgtttgatcgcttcgacctgcagtttgttgtcctgcgtcatggggtatctccttacagggcgagttcgctgtttaaaaccagtgccagcagagcctggcgcgcatagatgccgttacccgcctgctggaaataccaggcatacggggttttatcgacatcggtggtgatttcgtcgatgcgcggcagcgggtgcagtaccttcatattgtcgcgcgccgtagcgagatcggcggcgcgcagaatgaattgcgctttgacgttggcatattctgacggatcgagccgctctttctgcacgcgcgtcatgtagaggatatcgagctgcggcatcacctcttcaaagctgtcgtgacgtgaccagctgatattcttctcatccagcatatcggtgatataggccggcatcgccagcgcatcgggcgcgataaagaagaagcggttgccgtcaaacttcgccagcgcctgggtcagggagtggacggtgcggccatacttcaggtcgccgaccatcgccacattcagctgattaaggcggctctgcgtctcctgaatggtgaagagatcaagcagcgtctgggtcggatgctggttcgcgccgtcaccggcgttgagaatcgggatgccaccggagaaactcggtcgccagccgcgccgcgccttcctgcgggtgacgcatcacaatggcatcgacgtaggtgctaatcactgaaatggtgtcggccagggtttcgccttttttgcccagcgacgtattactaccgtcagcaaagcccaccgctgacgcgccgaggcgatgaatggcggtttcaaacgacaggcgggtacgggtcgacgcctcaaagaagcagctggcgataaccttgtgcttcagcagttccggctgcgggtgggctttcagctttgcggcggtgtgtagcgccagttccagctcttcacgactgaggtcgttaattgaaataatgtgcttgcgatatagcgggttagccatagctttctcctctgcgcggccggattgcggacaaaaaaaagcccctgcttaaggggcttttttaagatcgggtcgatgaccgaaagaaacagtagcaccgcctgcggtcaggcgtgattgagcgtcaaattgtccgctgtgctgtagcatatttcctccggcaaattgggccgcattatacccgttcgcggtgggtcagcaagaggaaaacgtttgcgcctgcctggccgatcggaggccaggccagatcagacggtgaatcgcccgctatgagcagacgcaactcagcgtcctcagccgcacgatgctggtcggtcagcgctggcccagcgtggccaccattaccgctttaatcgtgtgcatccggttctcagcctggtcgaacacaatgctgtgtggtgattcgaacacctcgttgctcacttccatgccgttgggcagatcgtactgttccgccatctgctggcccagcgtggtctgatcgtcgtggaaggcgggcagacagtgcagaaatttaacctgcgggttgccggtcagatcgagcatcgcccggttcacctgatagtcacgcagcagcgcgatacgctcggcccacaccgctttggcttcgcccatcgacacccagacatcggtgtagataaagtcagcgcctttcacgccgtcggcaatatgttcggtgagggtgattttcccgccggtctgctgcgcggcttcacggcactgcgccaccagttgctcctctggccagcagcttttcggtgccaccagacgcagatccagccccacctgtgcggcggcttccagcatggtgttgcccatgttgttgcgcgcatcacccacataaaccagcgtcatctcgctgagttttttgcccggcagatgctcctgcatggtcagcaggtcggccagcagctgggtcggatgaaactcggtggtcaggccgttccacaccggcacaccggcatgttccgccagcgtttccaccagatcctgaccgtaaccgcgatactgaatgccatcgtacatccggcccagcacccgcgcggtgtcgcgcatcgactctttatggccgatctggctgccactcgggccaagataggtgacgttcgcaccctgatcgtaagcggcaacttcgaaagagcatcgggtacgggtcgagtctttttcgaagatgagcgcgatgtttttacctttcagatgctgcacttcctgggcgctttttttcgcccgtttcaattcagcggaaagggtaagcaggtgatcaatctcggcgggcgtaaaatccagaagcctgaggaaatggcgctgatacagctgactcatacaacactccggtaatcattaaagtgaattaaaattcaatctaaccgtatgaatatgcattttcaagtgcagggctaataaacttttcgttttgtgtagtggcgcgacgggcagtatgggaaaataattgattattgccgaactcagagaggatatcgtcatggcatatgaagcattactggaagagcagcaggaagagacgcggcagattatcgaagagctgctggaggatggcagcgatcctgatgcgctttataccatcgagcaccatctctcatgcaataattttgattcgctggaaaaagcggccgttgatgcgttcaagctgggttatgaagtgaccgagccggaagagctggagctggaagatggcaccaccgtgatgtgcgtcgacatcatcagcgaatccgccctgaagcctgaactgatcgatgtgcaggttgagcagctggtgaacctgattggtaagtacaacgtcgattacgacggctggggcacctattttgaagatcccgatgccgaagatgaagatgacgacgccatcgaagatgaagatgatgatggtattcgccactaagtagccggggcggagagttctccgcctgtcacccctgccacctgttttaacatcatgaactacgcacccttacttgaacctatctatcagtttctgcactgccgcacgccacaggcctggattgatgaggcgcgcaagccggaaaatctgaccctgctgttaaccgaccatctggtgtgcgaaactaaaagccgcgcagaccgcggtgtggttgatccgcaaatatgttgccgacaaacccagcggcgacgccattctggcgtggctgaaaccctatgaagattttatcttccgcgaagatggcgacagcgactttatcaacgcccataagaacctgactaaacatatcatcgtgcgcaatgcgctgccgtgggcggatgagctggtggagaagatggtgctgctgattaaagaggagctgcatcacttctatcaggtgtgggaaattatgcagtcgcgcgggctggtctatcagaagatcacctccagccgctatgccaaatcgctgctgcgcgaagtcaccacccatgaaccggaaacgctggtggataagctgatatgcggcgcttacatcgaggcgcgctcctgcgagcgtttcgccagtctggcaccttatcttgatgacgaactggcgaagttctatctgtcgctgttgcgctcagaggcgcggcattatcaggactatttaaccctggcggcgcagattgccaccagagacatcacgccgcgggtgcaggtgattggggcaacagaagggcggttaattagcgaacccgacaacgaattacgctttcacagcggcgtaccggcgttctgaaaagagtaaacggcgctcttacgatggccgtttattttttatattgaaccgggttgattttattaataataaaaagataagtattaacttttaatctaatatgaacgcgttacctccgaaaaatataatttgagtgacccctcacaaaatattttatctcttctgttttttctttgcggaataactatagtgctcttgccggattaggattgttatttttcaagcaaaacctgattcataacgcctctttgccagagagggttgtgaatcaggtttttttttgcaccgggtatagccggggaaaagaatcagcgacttttttttggcgtccagttttgctaataagcatttaatggaaggagtcattaacatgaggggaaagcgcggtattccgttatttattttactgtttttgcagccacctggcgcatgggctgacttttccgacgcattatcgttctctgacaatgctttcctgcgtgattcgcaactcgatctcagactgcgtaatcactggaagtatctcaaggaaaatgaagcgcagcctgccaccgttcataatgcctggggacaggcgtcaagcctgaattttcgttccggctatcagtgggactggctgggttttgatgcaacttatacccgagcgatcaggctgggagccagcgactactttgccacgcgcggcctgctttacgacagcggcggtcatcagcaaaaagctgacgcgcacggcttcagcaagtttggtgaaacgctatctgaaagtgaagctgggggacgcgaatgcgggatttaaaggaaaagcgggctggcaggagttaaaaaacatcggcgtgctgaccaccacggaccgcttgtcacgcaacagttactcaggctatagcggcgcgctgaacgtgcagaagatacggctggatttggcttacgtgaccaaaacgcttcgccacgactcgccggagagtcttgccctgcaaacccaggaccgacgaaaaattaatgcgatctataccggcgcactgagctataccggtgatcgcggacgtctcgcctacgcatttggcgaagcggaagcctaccagcggcgtcatgttatcgaagcgaattattcgctctcgccggactggcgcttgtcctctcaaatttatggcagtcaggggctggaaaattataaaagcatggcggccagcaaaagatcgtacgataaccacgcgtggcactatgtcggtgaagcagactggattaacgacagatggacacagaaattcgctgccgcctggacttcggcacccaaacataatgcggtgggatattatgtgcgcccgctgacaaaaaatacccgtgggcgtttcaacgccctgacctctgccggaaaagattatacccgtgataaagaactggcgctggtgtcgcagacggaatttgaaatttcaaaaggcatttttagcggatttcagattaactatggacagtttaattatcgtaatacgcgtatgcgttcgggggaagtcgcgctcataaaccgcttcatcgaaccccatccggtcctgaaggatttatcggtctttacgctattcggttatggctggtcatataagaataataaagaaaccccggtttttaatgcgcaagggaaatatatgcgttctcccagcctttctgcagagatcgcggttgaatataaattaaatctgttcagataaggaaaatacgatgaaaagaatttttaaagcgttgctgattcttattgtggttggggctgtcgcaggcgaagcctttgccgccgatgtcactctctacgttacgcggcatggtaaaacgatgttcaacacggtgcatcgcgcgcagggatgggcagatactccgctaacgccagcgggggtagaggtggcgcaaaagctgggacgcggtctgcagacgatcccgtttatcgccgtctggtccagcgatgctggcagagcgagagaaaccgcgcagcttgtgatgcaggcatggaaaacgccgctgccgctgaacgaaacgccgggaattgcgggaagtgggctttggcctgtatgagggcgatctgaataataatatgttgaacgatgccgcccatcagttgggatttgcatccgatacggcgctaatggaggcctatggcaaaggcaaggttcatgtcgacaggatcatagacgctatccggcaggcggaagcgtcaggcacgccggcactgagaggcattaaatcagcaggcatggccgaaagctatcagcaggttgcgaagcgaatggtcgatagtctgactgagatagcgcagcaggcccggcagcagggcggcggtaacgttctggtggtcacgcatggcctggcgattacagcgctactgcaggcgcttggcgatacgtcgttaaaccagacgctggacaatgcgagcgtaacccggctgcgctataccgacagcagagagttcgtgattgaatccatcaacgatatgagttacgtagagcgcggcttataacttccgcaacatacgcacttcgcagtcgacatggccggtgcagcccatcgcgctgtcgatatgctcaaagccgagtgactcataaagtttaatggcccgcgtcaggctggcggtggtttccagatagcagcgacggaaaccgtggctgcgtgcatgttctatcgcccgcagcgccagttcgcgtgccagaccctgaccgcgcacctccggcagaaagtacatcttttgcagttcgcagatatcgggcgcgctgcaggcgagcggcgcaacaccgccgccgccgaccaccttgccctgatactcaacaatccagtaggcgctctgttcggcactgtagagctcaaacagctggtcgagctgcggatcggaaacggtgtagcccttgtcagccgtcaggccgaactccgcggaaacgtcgcggatcacctgggcgatatgcggattatcggcggcagtaatcggccgcacctggaggtcaataagcggggtggcgctggtcgtcatcatctcttccggatttgtacgaggtcaataaaaaagccgggcaagcccggctttatgaataagctgtcagctaagacgcttacaatgccgcaatgaccgcctgctgttcaatcagttttgtttttgattgttgcaggtccgctacgcgttcgcgctctttcgccaccaccgcttccggggcgcgcgaaacaaagccttcgttcgccagcttggtctcgatcttctcgatttccacatccagcttaaccagctctttcgccagacgctccagctcagcggttttatccaccagatccgccatcgggatcagcagctctgcgccttcaaccagtttggtcaccgacaccggacctttctcgcccgcaggcagaatggtcaggctttccagacgcgccaggcgcgacaggaagttgcggttagcttcaacgcgacgcagtgccgcaggcgagcagtcacgcagcagcacatccagcggcttgctcagtgcgatgttcatctcggcacggatattacgcaccgccacgatcgcctgtttcatccactcaatgtccgctttcgcttcggcatcttctttcgccgcatcgtactgcgggaaaggctgcagcatgatggtgtcgtcgctgatatttttcagccccttcacgcgctgccagatggtttcagtgataaacggaatgatcggatgcgccagacgcagcagcgcttccagcacgtgaaccagcgtatgacgggtgccacgcagttcagattcactgccgctgttcatgaccggcttggtcagctccagataccagtcgcagaactggttccaggtgaagtcatacagcaggttagccgcgatatcgaaacggtagctatccagcgcttcacggtacgctttcaccgtgttgttgaactcggtcaggatccagcgatctgccagcgacagcgtcatttcgccgccattctgtccgcaatcctgctcttcggtgttcatcagcacaaagcggctggcgttccacagcttgttacagaagttgcgatagccttccaggcgcttcatgtcccagttgatgtcgcgaccggtagaggccagcgccgccagggtgaaacgcagcgcatcggtgcctgatggctcgatgccgtccgggaaactgcttctcggtacgtttgcggattttctccgccagctgtggctgcatcatgttgccggtgcgtttttccagcagtgcttccagtgaaatgccgtcgaccatatccagcgggtcaatcacgttgcccttggatttcgacatcttctgaccttcttcatcacggatcagaccggtcatgtagacggttttaaacggtacctgtggtttgccgttttcatctttgatgaagtgcatggtcagcatgatcatgcgggcaatccagaagaagatgatgtcgaagccgctgaccagcacgctggtcggatggaaagtacgcagcgcttcggtgttttccggccagcccagggtggagaaggtccacagacctgaggagaaccaggtatccagcacgtcatcatcctgacgcagcgccacatcggcggccaggttattctcggcgcgcacttcgtcttcggtgcggccgacgtagacgttaccgttgtcgtcataccacgccgggatgcggtgaccccaccagagctgacgggagatacaccagtcctgaatatcgcgcatccaggagaagtacatgttttcgtactgcttcggtacaaactggatgtcgccgttttcaacggcttcaaccgcgactttcgccagcggtgcggtacgcacataccactggtcagtcagcatcggctcgataaccacgccgccacggtcgccgtaaggcacggtcagatcgtggggtttgatctcttcaagcaggccgagttcatcgacagcggcaacaatcgctttacgcgccgcaaagcgttccatgttctggaaagccgccgggatctcatcggaacaggcatcgctggcttcgccattggtgtcatacacctgagcacggtcgcggatatcgccgtcgaaggtcaggatgttgatcatcggcagtttgtgacgacggccgacttcatagtcgttgaagtcatgcgccggggtgatcttgacgcagccggtgcctttttccatgtcggcatgttcgtcgccaacgatagggataagacggccaaccagcggcagcatcacaaatttgccgatcagatctttgtaacgtggatcttccgggttaacggcgacgccggtatcgcccagcagggtttccggacgcgtggtggcgaccaccagataatctttgccgtcggcggtttttgcgccgtcagccagcggatagcggatatgccacatcgagcctttgctctcgcggttttccacttccaaatcggagattgcggtacgcagttttggatcccagttcaccaggcgtttgccacggtagatcaggttctctttatagaggcgaacaaacacctctttcacggcgttggaaaggccgtcgtccatggtgaagcgctcgcgctcccagtcgacggagttgcccagacggcgcatctggcgggtgatggtgccgccggactctgctttccactgccagattttgtcgatgaacgcatcacggccatagtcctggcgcgtcttgccctcttcagccgcaattttgcgctcaactaccatctgcgtggcgatgcccgcgtggtcagtaccggcctgccacagggtatttttcccctgcatgcgctggtaacggatcatggtgtccatgatggtttgctggaaggcgtgacccatgtgcaagctaccggtgacgtttcggcggcgggatcatgatgcaaaagctttcctggctggtatcgccattcggtttgaagtagccctgcttttcccaatgctcgtaaagcggctgctcgatatcttgcgggttatatgtcttttccatttctgctatgtcgtttgcggctgtggtggcgctgccgtattcaattggaatccaacgctgcgatacgctttatagcggtcgcgcgccagttgtttgagcgtgtcttcgtaaggaacgaagtctatcacttcatggaaagcagtagcaaaatctgcgaagtggggcagcaggctaatcagcaggtcgcgcggtgaactgccgcgacgctgtggccaggccagctcaaccggcgcaccgtagcgcgggccttcacccgccaggttatgcggcacgaaggcgtttgccggtcgttgccacagcgcttcgtcaagtcgaatggcttgctgttcatcttcgcaggcgatcaacacccgctttccggcccgccagcgtgtttccgccagattgcacaccagcgcttcaacggcgctaaggccatcgctcgttgcatcggtttccagcacgtagaaggttgcgtttttcatcggtttgctcatcagaagatcaagggcggaatgatatccgcccttgctgtcagaaaagagggcgcttaatcgtcgccgttcaatcctgcccgattcaacagaaattgcgacagcatcggcaccggacgtccggtggcgcctttggccttgccggagcgccaggcggtaccggcgatatccaggtgtgcccagttatatttgcgggcaaagcgtgccaggaagcaggcggcggtaatcgcgccgccgggacgtccaccaatgttcgccatatcggcaaagttggactccagctgctcctggaactcatccgccatcggcagacgccaggcgcgatcgcctgactgctccgaggcgctgatcagctcatgcgccagcggattgtggttcgacagcaggccactgatgtgatgacccagcgcaatcacgcaggcaccggtcagcgtcgcgacgtcaatcaccacttccggatcgaaacgttcaacataggtcagcgcatcgcacaggaccaggcggccttcggcatcggtgttcagcacctcaaccgtctggccagacatggtggtcagcacgtcgcccggacgcatcgatcggccatccggcatgttttcacagcccgccagcacgccaaccacgttcagcggcagattcagctctgccaccatacgcatcacgccatagacggcggccgcgccgcacatgtcatacttcatttcgtccatgctgtcggcaggcttgatggagatgccgccggagtcaaaggtcagccctttacccaccagcacaatcggacgtgcttccgcatccggattgcctttgtattcaattaccgacatcagcgattcgttttgcgaaccggccccgacagcgagataggcgttcatgcccagctctttcatctgctgttcgccaatgacgcgggtggtgacatttttgctgaaggcatccgccagctgacgcgcctgtgacgccagataggcggcgttacagatattaggtggcatgttgccgagatctttagccgctttcataccggcagcgaccgctaatccatgctggatcgcccgttcgccgctggtcagttcacggcgggtcggcacgttaaagaccagcttgcgcagcggacgacgtggctctgctttgttacttttcagctggtcaaagttgtagagcgcctctttggaggtctctactgcctgacgcactttccagtaggtgttgcggcctttgacatgcagctcggtcaggaagcagaccgcttccattgagccggtgtcgttgagcgtgttaatggttttctgaatgacctgcttgtactggcgttcatccagctcacgctctttaccgcagccaatcagcagaatacgctcggacaggatatttggcacatgatgcagcagcagtgtctggcccacttttccttccagctcgccgcggcgcagcagggcgctgatgtagccgtcgctgattttatccagctgctcggcaatcggtgacagacgacgcggttcgaaaacgccaacgacaatgcaggcactgcgctgtttttccgggcttccgctttttacactgaactccatgcactctcctgaatcttaaagacaacggccgctgctgccgctagaatgtagcgcgctcatgacccatttattcatcgtcgcagcatgacattctgctgctggaggtcataatgaatcagggtgacaagatgttgttttttcaccacccggacgcgtttttcatacaaatttagctacggcgacggccattgatgaagaaaaatggctgataagcgttgaaactagcgattttcctgcaaaaagacaagttttcacaggcgtactaagcgtgatcatcattagatatctggttcgggaaacgctcaaaagccagctggctatcctgtttatcctgctactcatcttcttttgtcagaagttagtcaggatcctgggtgccgcggtggatggcgaagtgccgacaaacctcgttctgaccttgttaggactcggtgtgcctcaaatggcacaacttatactgcccttaagtctgtttctggcgatcctgatgacgctggggcggctctacacggaaagtgaaattaccgtgatgcacgcctgcggcctgagtaaggccgtcctggtgaaagcggcgatggtgctgatgctgtttacctcgatagtggcggccgtgaacgtcatctggctggggccgtggtcatcccgctatcaggatgaggtgacgcagaaacgccaaagcgaacccgggcgcggcggcaatggctgccgggcagttccagacctccagcgacggcagcgccgtgctgtttgtcgaggatgtgaagggcaacaactttggtaacgtgttcctggcgcagttacggccaaagggcaacgcgcgaccgtcggtggtgctggctgacagcggtcacatggagcagcataaagatggctcgcaggtggtgacgctggataaaggcacccgttttgagggcaccgctctgctgcgtgatttccgtatcaccgacttcaccaattatcaggccatcgtaggctataaagcggcaacgctcgatcctaacgatgcagaacaggcaagcctgaccgacctgttcgcgaataagacacctgagtttcaggccgagctgcactggcgtctgacgctggtgttctcggtgctggtgatggcgctgatggtagtgccgctcagcgtggtgaacccacgtcaggggcgcgtgctgtcgatgctgcccgccatgatgctctatctgattttcttcctgttgcagagctcgctgaagtcgagcggcgcgaaagggcggctcgatccggcgctctggatgtgggtggtgaatatcagctatctggtgctggcggtgctccttaacctgtgggatacggtgccgatgcgtcggattcgcgcccgctttacccgcggagggtcggtctgatgtttcgcgtacttgaccgctatatcggtaaaaccattttcaataccattatgctgacgctgttcatgctggtgtcgctttccggcatcatcaagttcgtcgatcagctgcgcaagaccggccagggcagctacaacgcgctgagcgccggttactacacgcttcttagcgtaccgaaagatattgagatctttttcccgatggcggctctgttgggcgcactgctgggactgggcgcgctggcgcagcgcagtgaactggtggtgatgcaggcggcgggctttacccgcatgcaggttgcgctgtcagtgatgaaaacggcgattccgctggtgttgctgaccatggcgattggcgagtttgttgcgccctcgggcgagcagatggcgcgtaattaccgggcgcagcagctttacggcggtgcgctggtctcaacacagaacggtctgtgggcgaaagatggcaatagctttatctttatcgagcgcatcaaaggcgacaacgaaattgatggcgtgagcatctacagctttaacgatcagcgtcgtctgcagagcgtgcgttacgcggcgacggcgacctgggatgcggctaagaagcgctggatactgtcgcaggttgatgagtctaacctgaccgatcctaaacagattaccggttcacagagcctgagtggcgagtggaaaaccaatctgacgccggacaagctgggtgtggttgcgctggatccggacgcgttatcgattcgcggtctgcatagctacagtaaatatctgaagcagagcggccaggagtcgggacgttatcagctgaatatgtggagcaaaatcttccagccgctgtcggtggcggtgatgatgctgatggcgctgtcgtttatcttcggaccgctgcgtagcgtgtcgatgggtgtgcgtgtcgtaaccggtatcagttttggcttcctgttctacgtgctggaccagatttttggcccgctgagtctggtttacggtctgccgccgattctgggagcgattctgccgagttttgcgttcttcgctatcagtatgtttatgttgattaagcggcgctaagcgcagtaaatgcagtaaaagaaaaggccgcgcaagcggccttttttgtgaccggtgttcaggctcagggcaggctcccatcgctttacgttttgcagccgtgtgggagtaacggtttcagcggcctgattgtctgtacgtaaagccgatggtctgtttgagtgaaggctcagggagcatacgccttccacaaagacgcaaaagcgccatccgtggcggctcagcgcgggcgattacgcacctcatccctgaggtgcgcccgtagccgggccaacgctttgcgttgttcaaaaacgctcccggcgtttttgtcccaggcccgcgatgctttgctacaggcgtatgctcccatcgctttacgtttgtgggtcgtctgtaagccacggtttcagcggctttattctgcgctgacgccctgtttatgcggagtgccgggtcgtctctttcagtgtcctgataagttgctctctgttcagggctacgcaataggcgggcgtcccacgctcgaaacgccagccttccgctaatgctcccgcatccacggcatcaaatccaaaggcttcatataatgccgtggcggtcgctttcccttcgctatcatcccccgccagcggtaacgcctgccggttggcatcgcccggcggcaggccctgcgtttcaagatcggtcatgcggatggcattgaatgccttggtgacgcggctgtcaggaagcaggcgggcaagccgttcactggtgctgatgcggccattgagcagctcttcaatttcgccatcgcggtcgggatagtaattgaccgcatcaagcacgatttttccccgcaattctgtggccggaagttgttccgttgccgtgagcggcacggcaatcaccaccgcgtcgccgaactctgcggcctcggtggcggtgccggtttcacagccaatcatcggtttcaggctgaacagcgttcgtggatcgcgcgagttgctgagcatcacctgatgtcctgcctgaatcgccagttttgcaatcgcccggccaacaaagcctgcgccaataatgcctattttcatacgtttctccttgatgagtttcacgcactgaccttaattaaaaacaggaggtgaataaatcgacaaacagacgcaatataaacaaccaacaggagggaatcatggatcggcttaccagcatgaacgtgttcgttaccgtcgcggaatcgggctcgtttgccgcagccgccgggcatttgcaaatctcaccgcagatggtggcgaagcatatcgccatgctggagaagcatctcggtacgctgcttctgcatcgcaccacccgacgacaaagtctgacggatgtgggccgcaactatttcgaacgctgcaaaatcgtgctggcagaggtgcaggaagcggatgcgatcgcgctggatatgcagcagcggccgtccggtacgctgaaggtcagcgccccggtcacgtttggttcttttagcctggcgccgtttgtgacccgctatcttgaccgatttccggaaacgcaggtcgatcttgaactcagcgatcggctggtcgatccgtttgaagagggttatgaggtggtgatccggattggtgcgctggcggacagttcgatcatcgcccacccactgcagccctaccggctgatagcctgcgcgtcgccagcctatctggcgcggcacggtgttcccgccacgccagcggagctggtgaaccacgcctgtctcgtttatggcatctggtcgccctcaaaaccctgccgctgggtattcagtcaggccggtaaggttgaagaggtgcatccgcaggggcgcatgcgatcaaatgactggaaagcgctgctgcatgcggcgctggagggttatggcattaccctggggccggccaccattctctctgaagagatcagacagggccggctggtccaggtgctgcccgattatgccgggccagcacgacccatgcatgtgctgatcccggcgggccgccgccagacggtgaaaatccgcagctttgttagcgccattatcaccgagtttggcctctatccacccacatctggctaaaccaggcggttatctgttcagcagcggcagtaactggggcagctgcgacaacaggtagaggatcagcccgatggtgccgccaaccagcgtgccgttgatgcggataaactgcagatctttgccgatattaagttcgatctgctgcgacatgtcgcgtgcatcccagctcttcacggtgtcgctgatgtggcgcgtcaggaagccagcaaactctggcgcaacgctgcgtgcggcctgttccagatgctgattcatcgagtcacgcagcgccgggtcggccgccagggtttcgcccagccacaatgctgcaccgcgcactttctcctgcactcgtgaatcatcactgctgagatccgccttgagccagttgcgcatatcattccacagctcgccgatgtagcggttaaacgaggcatcctctttcagccagcctttgatctcctcggcacgttcagccatctccgggtcgttctgcagtttaacgatcagtttgtcgaccgcccggttgaaaccaaggcgcagctcatgcccctgatccagcgccacatcatccagcagtgaatcgaccgcgtttgccaccagctcggcgctgtgttcgcccagccattcggtcggcaacattttggctttgatcggatgctcgcgtttcagccagcgcaccagctgcatggcaataaactcgcgggtgctgggcttgtgcagcagcttcagcagctgttcgattgccgcatccagcagcgcctgatgacggttgtttttcgtcaggctctccagcagcagggcgctggtctggctgagatcgaccttgtcgatggcgcgatgtactgcgcggcgcatgaaattctggatccgtgtgtcatcggtcagatcaaggaagccgcgcatgacctgcagcagatggcggccaatgcggtcagcattgcccggcgcattcagccattgcgccagcaggttggaaggatcgtgacggcgaatcagattgagcagcgagtcggtatcaagaaacttctcctgcacaaagcgaccgaggttttcaccgatacgatctttgttgcgcggaatgatggcggtatgacgcgagataaagggcaccggcacgcgccggaacagtgcgaccaccgcgaaccagtccgccagcgcgccgaccatcgcagcttctgctatcgcctttacgccgctgacccagaagccgggtggcagaaaaagcgtaacgataaaggtaattgcagccagcagtaacagcagcagcgccagacgtttcgtccgtttcagttcgtgttgtttatccatatcctgatcttagcagagagccggtttcatcggcgacgaccacccagcaggctgccgagtacgccacggatgatctgattggtaatctggcgcgtagcgcttttcgccatggtctgcaccacgccatcgtgcttgccgccgcgcgggccggttcggccaaacaggatctctttcagcccgccgagaataccgttatctaccgcgacgtcgtcgcctttcgccggaggcgcgctggcctgatcgctggcggcctgaaaccctttttgcagcttctcaaatgccgattcgcgatcaacttcgctgtcatatttgccatagagcggtgaatggttgatcaggccgttgcgttcatcgcctgtgaccggacccatacgtgagccaggtgcgatcaccatggcgcgttctaccaccgacggactgcctttggtatccaggaaggagatcaaggcttcgccggtgcccagcgcctgaatcgcctcgaaactgtcaaacgccggattggcgcgcagggtatcggcggcggtttttaccgctttctgatctttgggggtgaaggcgcgcagggcgtgctgaacgcggttgccgagctggcccagcacccgatcgggaatatctgccgggttctgggtgacgaaccagacgccgacccctttggagcggatcagccgcatgacctgttctattttctccagcagcaccggcggcgcgtcggtaaacagcaggtgcgcctcatcaaagaagaacaccagctttggctgatcgagatcgcccgcttccggcagatgctcataaagctccgacagcagccacagcaggctggtggcgtagagtttcggcatctggtagagcttctcagcagagaggatgttgatgacgcctttgccgttgctgtcgacacgcatccagtcggcaatatccagcatcggttcaccaaagaagtgctccgcgccctgttgctccagcgtcagtaacccgcgctggatggcgccgactgaggcgctgttgatgttgccgtagtgggtctgaaagctttttgcgttgtcaccgatgtactgagtcatggcgcgcagatctttgaagtccagcagcagcaaaccctggtcatcggcgatgcggaaaataatctgcaatacgccgctctgcacctcattcaggttcagcagtcgcgccagcagcagcggcccgagatcggagacggtagcgcgaacaggatgacctttctcgccgaagatatcccatagcaccaccggattgctctgcggctgccagtcggtgacgccgattttcgccagcctctcctgcagcttttcgctggactggccagccatcgccacgccggtcaaatcgcctttaacgtcagccataaagaccggcacgccgctggcggagaacgattcagccagtttctgcagcgtaacggttttaccggtgccggtcgcgccggtgatcaggccatggcggttggccatttgcggcaacagatgaagttcgacgtctggcgtacgggcaatcagtagcggggaagtcatgatttccactctcaggcattgggttatgcctgaaggatagcaagccggagcggcacaggaggagaactattcaccaaaaaaaggccgctgcccggggagcagcggcctgcaacagtggtttacttctgcacctcttcaaaattgagcaggctgaccccgatgccctgctgcaggtgactgaggttgctgcgcaccgccacctgggttgcgccctgtaacagcatgacaaacggcgaatcctgctggatgcgggtttgcagcccggtgtagaggttgcgacgtttcaccgcatcgctctctccggcggcggcgcgggtctgtgcactcagctccggaatcgtccagccgacgcgccacgccagggttttgccgccgcccggcacgttataggcaaaggtactggcattggtattgggatcgatgtagtccgcgccccagtaagtaaagatggcctggaagtcccggctgcgcattttgctccacagctccgattccgccaccggctggatatcaagctgcacatccgctttggcaaagctggcctgcagtgcctgcgccacatcaatgtaaggcggctggttcaccaccgtcagcgcgatatgggtgccaggtttgatgccgcctttttgcagtatcgcctgtgcctttttcagatcgtaatggaacggtgtcgtgttcagtgcaccatcgaagccgtccggcaggaagctctgatgaatgcggtactgacctttcagcagctggttcgccaggctgtcatagtcaaccagccagcgcgccgcctgccacaacgccggattccccagcgccggttgctgcgggctttgggtgttaaagcccaggtagtaaaccaggctggaagggaaggcatcaatacgcacattggcggtgttcttcagcgcggtaatctgatccgggccgagctgataggcgacatccacatcaccctgctggatcagcagacggcggctgcccggatcggccacacctttcagcaatacccgcttcagatgcggcttccggatgctgttgggattggcttccagcaccagcgcctgcagcgggacaaactgtttgatggcataggcggcgctgccggcggagtgcaccttcagccagctattgccgtaatcgttgttgctggcgtgttcttgtgccagtttgctgtcgacgatggaggagaccggcgcggtcagcaggcgcagcgccagatcgctgccgatctccgctggccagcgcagctcaagctggtggtcgttgatcaccgtgaactgctgatcgatattttctggcgtccagccaaattcacccagaataaaagagggcgctttattgagttttaccgcgcgggttaatgagaagaccacatcctgtgcggtcacgggatgaccactggcgaagcgggcctgcggattaagatcaaacaccaggctgtgaggcgttttgcctgcctgccagcgcgtagccgccagcggtgagagctgctgcggattctgatgatccggctccagcagcgtctggtagatattgcgcaggctactgttgctgacggtctcaaaactttcagccggatcgaaactgatgatgccatcaagcggaacggcaatcaccagcgtgtcgccaggcgtggcggcgtgtgccgggtgaaccagtgccagagccgtaaacagggacaagagtgtttttcgcatggagagttatcctgagtcgttgatagctctactctatcgggcgccggataatctccaaatgcgggtttcttatgagctttgcacaattattagcgtagtcgttcaggcaaagagacaaaataagataatgacgggcagtaattattttattgtcattttacagcgggcggaataaagccggttttactcagccgatcacaaattgcgcacagtctgattgtatgactatcaaagtcactatagtgttgacgatgagaatcattctcttgtatggaagtatgatatttttttatcggttatctggcgtgatgatgacagagtgaaaataataaccctcattcctgcgttaaaagagttaaatacccgatgtttatgcggttttacccccgatttccgcgctgtaaatcttttacctctccgcaaccctttcgcaacaccatgataaacttttactaagacacatcttaaattcaatttttacattcagacatatctatatccctaagattgccaggttattaaccgataagttccgttagtcaccgaaccataattctacctgcccttgtctgttctgccgtcgtctgtgccgcgtgcgttgatctctgcggggaattttccgcctgcactcagcctttcagcttcataacaaataaagcgggtatttagcagatgagagtcgtgcggatatgcttttagaaaaacccaccaccaggcgtaaatttttgctcggttcactgctggcgttgccattaagtgaactggtcttcaaaggcattactgcggcacaggcggcagagatggccgcaccggagttagccgattacaaaccgatcttttttagtgccgatgagtggcagtttatcctggccaccactgaccgtttgattccggcaggcggcaaaggcaaagcgccgggcgcgctggaaactaacgtgccgatctttatcgatcagcagctgcacagcgaagcgtttggcagcgaaatctacatgcaggggccgttcaatacgcaggcgcccgcaaccatgggttaccagatcccgtttccgcccacagcagatgtatcagaccggtatccggctgattaatcagtggtcgcagaacacccatcagaaagcgtttcatgcgctgacgctggaagagaaagatgcggtgctgacccaggtaaacaaaaacgagatcgactttgctgcactgggcgaagccgatcttaagcctgcgcatttcttcagccagctgctttccgataccaagcatggctaccttgctgacccgatgtacggcggtaataaaggcatgaaagcctggatcgccatcggcttccccggcgcgcgtgccagcttcaccgaatgggtgaaacagcacaacgttccttatccgctgggtccggtcagtgtgaagggcgaacgcgcgtagggcgcgtccacatcaggtatttgaaacaggattatcatggcacaggttactaaaaaagaagtcgacgtcgtggtctgcggcctcggctgggcaggctcgctgatgagcatcgagctggcactggcaggtctggatgtgcgcgcccttgagcgcggcggcgatcgcgattatgacgagttcgcctacccgaaaccggcggatgaatacgcctatgcggtgcgcaataaagtgtttgccacccccgccgaagtggcggtcaccgtgcgctacaacagcagccagacggcattgccaacccgtaaatggggtgcgtttgcaccgggcaccggcgtaggcggttccggcctgcactggaccgcagtactgatccgtccgacaccgactgatatcaaactgaagacttatgtcgacgaggcttacaagccgggcattctgcaggatgatatgcgggtgatggacttcccgttcagctgggaagagatcgaaccctactactacaaattcgaactgatttgcggccagtcgggtaacaccggcaacctgcgcggcaaaattctggaaggcggcgatccgtttgaaggcccgcgttctgagccttatccgctgcctgcgctggatgacacgctgaacaacgtgatgttcaaagaggtggcgaccaaactcggttaccatccgttcccgaaacccgtcggcctgtgtgtcgcgtgcgtggaaaaacccgtacggcaaccagatcgcgccgtgcaactactgcggctactgcagtaaatatccctgcctgaactattccaaagcgtcgccgcagaccgccgtaatggattcactgaagcgtatgccgaacttctcctatgaagtgaatgcggaagtgatcaaggtcgtgctgaacgatgataagaaaaccgcgaaaggcgtgatctacatcgatgcacagggcaacgagtgcttccagccagcgaaaatcgtggtgctgagcagcttccagctctacaacgtgcgtctgatgctgctctccggcatcggcaagccttacaacccgattaccgaagagggtgtggtagggcgtaactacgcgttcctgtccaacggcggcgcgacgctgttcttcaaagataaaaacttcaatccgtacgctacggcgggcgcgaccggccagatgttcaacgatatctcgccaggcaacttcgacggcccatccctcggcttcctcggcggcgcgaagatccacagctcacaggcgaccggtacgccgatcagcaccgcgctgccaaaaggcacgccgacctggggcatgggatacaaggaaggtctggaggagtggtacggtcattcgatgaagatcagcatcaccaccacctgtcagtcttaccgcgatatctatctggatctcgatccgaactacaacgatcaccgtggcctgccactgctgcgcatgaccttcaactggaaagagaatgagctgaagctgcagcagcacctgaaaggcatcgtcggcaatatcgcgaaagagctgaaccctgacagcatgagcatgagcttcctgccaatgggcgcggactttgacctgaccaaatatgtctctacccacaacgtgggcggtgccgtaatgggcgataacccgaaaacctcggcgctgaacaagtatctgcagagctgggacgtgcataacgtctttgtgccgggcggtaacgctttcccgcagaacttccaggcgaacccgaccgataccatcggtgcgatcaccctgatggcggcacaggcgatcaaagatcagtatctgaaaaatcccggcccactggtacaggcataagcgcatgaataagctgaaactgaaatcttttatctttgccaacgcggtgctgttagccagcggatttgcgctgccggttcacgccgaagatgaagcgcaactgattaagcagggcgaatatctctcgcggctgggcgactgcatggcgtgccactcactgcctggcaagcctgactattccggcgggctggcgattgagtcgaaccttggcaccatcttctccaccaacatcacgcccgataagcagcacggcatcggcaactacagcgagcagcagttctctgacgcggtgcgcaaaggggtattaccggacggttcgcatctctatccggcgatgccttatcctgattacgccaaaatcagtgatgccgacatccacgcgctttacgtctacttcatgaaaggcgtgcagccaagcgcagaacagccgccggagaccgatctgagcttcccgttcagccagcgctggggcatgcgtttctggaactgggcgttcgcctcggataagccgttccagccgattggtggcgcttctgaagaggtcaaccgcggtgcctatatcgtggagagtctgggtcactgcggcagctgccatacgccgcgcggtctgggcatgaacgagaaagcgctggatagcggtgacgataaattcctggcaggcggcagcctgaacaactgggatgtgccgtcactgcgtggcctgccgcgctggagcgagcaggaagtggtggactacctgcagaccggccgtaacgataaagcggcggtgggcggcgagatgacctcggtgattgagcacagcagctcacacatgaccgacgccgatctgaaagccatcgcggcctacctgaagttcctgggcggcaacccgccattgcaggcgtacaacgtgcaggcgcagcaggcaacggaagcgaaactcactgccgcgaagaacctgagcgaaggcgagcgcctctatctggataactgcggtgcctgtcacttcgtgaccggcaaaggcgcgccagggatcttcccggagctggatcaggcgacgatcgtcaatgctaaagatccaaccggtctgatccacaccatcctggccggcgcacagcaaccttccaccgcgaaggccccgtcgaaactggcgatgccaggctttggtcagcgtctgagtgatgaagaggtggcgcagctggcgacctttattcgtcagggctggagcaacaccgcgccagcggtgagcaaagatcaggttgctgaagtgcgtaaaacgctgaagtaatcggtcctgagttttcccctctgcccgttcggagaggggaaatcccggattagtgaaaggtgcgcaccacttccagcacgccgttaatgataaactgcacacccatacagaccagtaaaaatcccatcaggcgcgatatcgcctcaatgccgcttttacccaccagcttcatgatggcacccgaactgcgcagtgaaacccacagaatcagactcaccagcaggaagatcagcactggcgcgacggtgatgacccaggccggaaagtcgacgccgcttcttaccgtcgaggcagaggagatgatcatcgcaatggtacccggccccgccgtactcggcatcgccagcggcacaaaggcgatattcaccggctctttggcttcatccagctcatccagtttctgctttgcttcgacagaatggccggcaggtttagccgggaacagcatccgaaaaccgataaaagcgacgatcaggccgcccgccatgcgcaggccaggaatggagatgccgaaggtattcagcaccgcgctgcccgcgtaccacgccaccatcatgatggcgaagacatagatagaagcctggcgcgcctgtcggttgcgctcctggaagttcatctcacccgccagccccagaaacagcgccacggtggtgagtggattggcgagcggcaggatcaccaccagccccagactgactgctttaattaactccagcatgacaaatcgccttttccgtggtgattagtgcttcggacgctccagcgcctcaagcagttccggaaagaagtcctgcaggatttcaggcgtcatcagttcgggatactgcatcagatgctcgcggatacgctcattgatgtccggcagcagacgctgggccgcagcgctggcggtgattttgtgcttcttcatggcgcgcagcagatcgcccggcagcgcgtcttcgtcgtcggcgtcatccaccatctccagcgcgtccagctcgtcgaacatctccatcagcgcttcggtctgtggcgtgcgcgactcatattcacgcggatgttcatcttccaggaaacgcagcatggcgcgcattggcgtgccgtctggcgtggatggcggctcggtggcgaaccagctcagcagctgatgcatggtgacctgatgaacgcgaaagccgctatcgaccagctcatcggccagcagctcggcggtttcgttttcaatcacgcagatgtgggtacgtttgggtttcgtactgctccagccactggtagatctcttcaatcacgccatcgtcatactcgaattttttggtgacatagctgtcgtcctgttcgtgaacgcaggcctgaatctgatcggggtcgaagtaaagtgcgatgttgatgcctttcatgcgtgctgtcctgtagaaatcaaaacaacactatagcgctcaaccccaggttaagggaatgtcaggcgtcacagcatggggggcgtttaacgctcccctcagagcagagaggggagagagaagggaaggtgatcaggagataaagtttttgccctgcttcagcaccacgtcacaggctttggttttcagcttctcacccatcggtgagttgctcaggctttgcagattcaactgctggccgttaccggtattcagcagaccggccacgccctgggtgtagtcggttttttgttcctgcgcggtggtggtgttcagaccgagcttgctcagcacctgatctttgacagactgcacattgtttttcaccacgttgtgttcgacgcaatactgcatcacaccggcggcgttggtcatgctgttggcgctgaccgctttatcgccgccgcccagcatgctggtaatggtagaaagcgacatgccgccattctgctgcgtggtgccggtggtgctgccgttgttctgctggctgagctgtgacgctgcactgctcagctgatcctgccagcttgccgctgatgcactgcctgcgaccagaagtgccgccagtccccatccccacgcactgcgttgtgcttgcttcatttcaacctcggtatgtgcttattcagttttcctaagaaaggctgaagagcagaaagttcctgacttccttttataaaaagcgtcttaaatagcactttgggaatcttctgtaataagagcgataaaatattcagatgcttgtgggtgttattattctgtgaagtgattttctgcagtcagtaataagcatattccgcggaaacattatttaatatcctcacgatttttatcaggaattgtcctggtttaaattaaagttaccgctttgcttatagcgtgttttctaatcgcttgcgtctggtctggtaatatttacctgagaaatcatattaatgtaacttcatgtattttggttattttatatttttagcgtagcggtgatttaaaccgggctgctgttttttgatgcgcttttttgtgccgtaattaaattgagttggcggagttttttattattccggcttgcgaaatcagccagagtgttcatgcttaatcactgtgtcaggcagttgtggcagatatttaatttaacgggagcgatattatggctggacagccagagcacaataataatgcagaggtcacgcttaaactcgctgaagagcaaatagccctgacgaagcaaaagattgtggatggacatgtccgtgttacccgttccacaactgagcatgacgaggtcatcagtacactgcttaaccgggagaaggttgaggttgagcatgtagcgaaagcgcaacccgttgaaacgatgcccgaaatcagggaagagaacggtgtactgattgtcccggtagtagaggaagaaatccaaatcgtcagaaagctggtgcttaaagaggagatccacatccgaaaagtgcaggaaaatgttccttttcaggaggtggtgacccgacgtgagcagcaggtgaacgttgaaagagatgacgatcaaattagctaacagagaggaacctatcatggcacatgaaaaaatcgtaacactgttcgattctgcaaatcaggcagaggccgcgaaaagaaatctcgtgaaagcaggcttttctgatcgggacatcagtcttatcagtggagaaacgtttgcaggaggaaggacactctatccgccatccgagcatctggcagcgtctgtttggtcactccgttgataaagagcaggccgatgtttacaccagagcgatggacaagggcggcgtagtgctgaccatccgtactgaggaggagaagctggctcgcgccatgaccattctccattctcatgactcggtggacgttccgtcacgtatgcaaagctcggttgagaatggcactaccgcgccgggcatcaacccgacgacggcaggcaagcagtttgctggtgagaccaacgaccgacaggttgaaccgcgacgcacctcactgaccggtgatgagagcgaagctgacattctgcgtctggccgaagagcaggttgaagtgggtaaacgtctggtgagcgaaggctctacccgtgttcgccgctataccgtgaccgataccgtatctgaagatatctcgctgcatgagcagcacgctgacatcttccgccgttcggtgaatgaacccgcgctggctggtgaagtggactggtccgagaaaaccgtcgaggttgctgagacgcatgagcagccggtgatcaacaaaacgacccacgtgaaagaagaagtggtggtgcgtaccgacggcagcgatcgtaccgagacgattaacgacacggtgcgtcgtcaggaagtggatatcgaccatgcacgaggtggtctggagcgcgaactgccgggtacaaccgcaggggtaaaacctgcgaccgccgccgcaggcacgcagtcaccaggtgcacataaccgtgaccacaaagagagcctgactgagaaggtgagtgagaaagccagcgaagtgaaggataaggtcgggaacaaactgcacgatcactcgcattgaggcgcttatcctgacaacaacaggcgctaatgggcaccgctgatgcccgatgctgagcatgcaagatgcaagaaggggccaaccgcgaggttggctcttttgcgtttgggggcagtaaaaacggacaacggcgtcatatcttcttcggtataatcaggaaatatctgcgcaggccgggcaggaataaaacataagggaataaagtgaactgtaaaccgatgcttttcgtactggcggtgttctccctgacggctcaggccgcccagagcggaaaaacgcttgagcacaaagactgggaagtggtctgtgataacaccctgacctgtcgcattgcgggttatgccaaagaagaggatccgtccggctccattctgcttacccgtgccgctggaccaggaacggagccagtgggagaagtgacgctgggtgataccgaagatgacagcacaccggcggaaaaactgacgctgtggatcgacgggaaatcagcaggcgatctggtggcggctgatgacaactggcggctttcggcaagtcagacctctgcggtaatcagtgccgtcaaaggcagcggtaaagtcgaatttaaaggcggcacaaagcctttcctgctttccggcgaaggcgcttatgccgtgctgctgaaagctgatgatgttcagggccgtatcggcacgccaggcgcgctcaccaaaaagggcaataaaccagaaagcagcgtggctaaggctgtgcccgcaccggttattcaggcggcaaaaaccctcagcggcgaaccccgtttgctgaccgcaccagaaatcgacgcgctgaaaacccgcctgctttcaacggtcaatcataatgacgatgacacgtgcgacagcctgtattcacctgcagaaaacagcgatccggaaaccgacggactgactcttacgccactggatgacacacacgctttgctttcggcgctctgctggcgagccgcttataacgaaggatatggctactgggtcattgataaccagctcaaaggcaagccggtgctggtgaccatctccgggtcggattacgacaaaggtgagattaccaatgtgcagaaaggccgcggtattggtgactgcatgagccaggaaagctgggtttgggacggcaaggctttccgcaaaagctatgacggcggaaccggcatgtgccgttatatccatgcgggcggcacctgggatctaccgacactggtaacggatgtgaagcctgtttcgggttaagcaggtgaacctgagaacccaagagacggttttttcagcagttgcacattcgcctgctgataagggttgcggaaacagggggtaacggtataatcctcaacgttttccgcatacccttcagtgccgaagtggcgaaatcggtagacgcagttgattcaaaatcaaccgccgcgaggcgtgccggttcgattccggccttcggcaccatcggaacatcaatagacgtcaacggacgtctttttttgtgcctgaaattcagtatttacccatcattcccgctatattaactctctcaaggccaaccaacttcaacgtacatttaccaacacctgttggtacagatgatggtatttccgattcgataatgcttgtaccaacagggaggggataagcatggcttaacagatatcaaagtcagaacagccaagccaatggataagcaatataagctgaccgatggcaacggtatgcatcttctcgtccatcctaatggttctaagtactggcgtttgcagtaccgttttgacggcaagcaaaagatgctggcacttggggtatatcctgaaatcacattggcggatgctagatcacgccgcgacgaagcgtgtaagctgttggcgaatggcgtcgatccaggagacaaaaagaaaagtgataaggttgagcagagaaaagcccatacttttaaagaggtggcgattgagtggcatagcaccaataaaaagtggtctgaagatcatgcccatcgtgtgctaaaaagcctggaaaataatctcttcgcagagctcggggagcgtaatatcacggaattaaagactcgcgatttattagcacctattaaagccgtggagatgtctggacgtcttgaggttgctgcccgtcttcaacagcgaaccacagcaatcatgcgttatgctgtgcagagtggattgattgattataaccccgctcaggagatggctggggcagttgcttctggaaacaggcaacatcgtccggcactggagttaaagcgcatccctgagttacttgagaaaatagatggctataccggcaggccgctaacccgcagggcaacagagcttactttgcttatctttattcgctccagtgagctgcgttttgctcgctggtcagagatagattttaaaacgtcaatgtggacaatcccgccggaaacgagagcctattcctggagtgaaacattctcatcgcggttcaaaaatgcgcacaccgcatctggttccgctttctaagcaggcattggcgatcctgaaacagataaaacagttttgtggggagcacgagctgattttcattggcgatcacgacccgcgtaaacccatgagtgaaaacacggttaacagtgccctacgggttatgggttacgacactaaagctgaggtttgcggtcacggctttcgtacaatggcctgtagttcgttaattgagtcagggctatggtcgaaggatgcggttgaaaggcagatgagccatatggaacgcaattcggtgcgggcggcgtatatccataaagcggaacatctggatgagcgcaagttgatgttgcagtggtgggctgattttctggatgcgaaccgggagaaagggattacgccgtttgactatgcgaagatcaaccggggagcaggtcacaggaggaacatatcaaaaacaggcagatacacaatttaaattacagtctctttcatcgatttttgtccattatgatgacactctatattcgtattgaaatcacagtaatacagtgcattttttagtaatatttaacctattgattatttcaaggaataatgaccgttgaaatttgcacaagctctcagcattctctcaaagtcttctccgtatgcggttagtaccgagagagagcactatcaagatcacctcgttggattcaagagatacatatacatcacgacagatatagaagcggattttaaaaaagcactcctatctgctaagtccaatcaagtcatcttcctatgcggaagtagtggtgatggcaagtctgagatcttgacgcagtacagccaaaagcacaaagtgactcatgacttccatttggatgcgactcacagcttcaatccaagccagacagccattcaagctcttgatcaaagattcacccagttcaagcaaagtcataaaccacttgttgtgggtattaacgttggtatgctcggcaattatgcagaagaaggttccaaagagcatagcgacatcaaaaaggtgctcagagactttctctctcgtaagcgatcagcaattccaaagcagtacgtattcttggattttgaagactatccaaaattcaccttcaatgctgagggctgtgcatcagactttgcagaaaaatttctaaaaagattgacagcacaaacgcttgagaatcctttctatgcgctttatgacaaagagctcaaatctctaggtcatactcgcctgacggcaaactatgcgctgctgagtcgcccttcagttcaggaatctctgatcggcttattactcaaagcccgtcttatcaaagatcagtttcctcacggcccgagcgttactggatttcattttccagttgctcgcggcggatggctacttgttcgacaacttgtttgcaggcagtgataacgagctgttatcccgtatacagggttttgacccaagtaatctgcacacgcgcaccgtcgatgagtttgtgcttcagcatgagctgggcattgaagatgagcgtttcaatgcgtttagatctaaaattaacgagcttggtttttacgaggtaaccaaagcaacgtcttttcttcgccttttctatttgcttcggggtgacaaagagctcagcaatgagtttgtaacgcctatccaaaacgagttcacaaacaatctggtagaaacctatgcatctgtctggatgcgacatcgtgatttcgatggttcaggaaagatgcgcaaactgcttggcagtttctacaaagaaacgctgatcgcagcgcttcaccgctattgtaatcgtcatgccccaacactcgacaaagacgagtatttagtttctgagcttaatggctacaaaacggcggtgtctcttgaagttaaggccgatttttcagcaatacaaaacagtacactcgaaaaaataggcaccttcaatgtgtatctgacagtcgatgaacaatcgcttaagccaatgccaattagcgtcaaactacttgagattttggtcaagattgggcaggggtatcgccctaacaagcacgacaaaaatgctgttttgttacttgatgaagcattggaacagatactgacagtagctaagcaaaaagagaccttttttattctcaagggtgataagcgctacaaaatcgtgaaagaagaaagtgactattttgaagtgagtggtatgcactaatgacgaccgataatttcacattaccgataaaggccggtttgccacaaacggtagctgataagttccaaaataagaatacgttgagcagttacattcccattcgtacgcaaggcaatgattttgactggtcatcagtcgtgggcttagtcctgcgtggattactttgtaaaaaaataggaaagtacaattaccaagattttactgcggattgcaaaaacaacttacaaaacaaattgggtgaagaggaattttggagtgtacttgaagatatgtatttcactaatgaaaatatattctcggtaacccctgagtttctgttgtttaagagccagaagagtcaagataacaagtacacgcgcgacatgcgaatggcatccttgtttattaatttacttcaaggacagcaaattgaacgatttgaatctaacttgaacttcctcgaagaggagtttcttaaaacgcttttagacaaaacaaagtcagatcgtgacaaggacttccaagtgaccgagtcaccatatttgccctatatagcagaggcgtttaaacgtgacctcgagtttttaactggttatccgaaatacctgttggatgagttcgagcgtttcttggcattttatggctttgcttacacggctcaattaagcctatcgttgtcggattggaaaacaggtgaagccccaaccgcgaaaccgctgtatttcatcatggatcatgagcgcgccagcagtgaacgtatccatatcaaaaagcacggttacaagctttttagcgaatcgtctttcaagctgtttcccttcctctctatgctggaaaatcttcaaccaaacccagaaaaattaaaaaaacctttgtggcaattggcaaaggatattaagagttcagagcggagtgatctagctgggtatattgaaaattacgcaaaaatgtttcgccacaacagaaaacttgaaacagcaatacctgaaaaagcagaaaccgcaattgattggttggaatatgctttgaagcttgctgaagaacagttcagagaccctaaaaccgaccgtccggggactatcaaaaaatatattaaagcggttgaagaaaacatggctactggcttcgtgcaagctcgtggtcgctctggtcgggtgttagtactcactcaagaccacattattttgcttactaacctggtggtgggtaaggaagaaaagcttcgcttccatgagctgataattggcttacagcaaagggggatttttgttgataagcatacagaacaagagcttattaagttctatgagcgaattggcaacgttgaacgcatgagtgatagtggagatgcagtgtatgtgcgcaaaacaatttgaatcgtttctggttgagcagtttttactgcacgcgaaaggaaacatccgcgcaggctatcgctaccagtttaactctcctgaccatgctaatagtcagcgacttttcgatgcgctcttagcgcgaaaaggaggagagagcgaagctcgcaatggtgtagcgctgagctatttagacctagaagactgcaaagtggtgccagtgcttcatagcgaagatgcgtgtgaaacgggctttaccgaaaactacatctctaatttgcgtgacgaaatagcaagccaggaaggtccgttgaagggctgtgcactggtggtgattcacaatagtcgcctagatactctcatcaactcggcggaagatcttggccagtctggccaggtttggagtccagggaaaatcaaattcgctcttagtggctttattgagcaatctgacaaatctcgagacgtttcgctttgccttttggacgaccaatttgacgcgattttggaagatggtgcgaccatgttcggtttcgagtctttatacaaggcagttgaggatggcgagctgtgtttcagcgagctaggcatgtttgaggatccttttgttgctgagttatcgggcaataaaaaacagatcaaacagcgcctagaagaaaaccgtacgctttaccaagagttgtcgtttgaagtagagcattttggtcagcaactcgaagaaaggctgaaaggctttagtagtaggtttatcaaagaacatttttctgacgatggttggaaagatgtggagtttgaaacttatcgagaagagatcaaaaggaataagattcagaaccttaagcatgaaggtgaagacgagaccaataatgcgcaagtgattggtcgctacccaaaagaaactaaagcaggattgcgtgaccgtcacttgattattgcactggaagaagggcaaagtgagtttgaacttaaactgagcttttctggcatcagcgatttaagaaaagagcagtttaaagtctcgccagcgaatgcacttggcaaacaagaagtcatcagcacgcgcctaactagtaaaggggcaaacgctactctagcagctagttatgccaatgagcctttgtttttcacgctagcattgaagcgtgacaatacctctgaacaccataacttccgttgcttggttgtcagaaaaggcgagtttcacctcgaggcattcaaaaacattttcgccgttgagccttcaaaaaaacgccttaccttgaaaacggtagacaacagcttggttattaacccggcgctaactgcaaaccgaagactagatgatgtcggtgaagtggttgaccgcacagaatttggtgttgtcgattttgaatctttggccaacgagtcagaagaaatcagctttgtggtgaaatcaggtgataattccctgacattttatattgagggtgaacaggtagaaagcagcctgtccttcccattgctgcttaaccaatctcgcttccacaaattgtttgacgatcacgtgtttggcgagctttatccgagtaaagacgttgtcgtgatcgatcatagtgaatttcgcgtcatggagccgcgcattagcctacttcgttgggaagagtgtttcgtttcagcaaaagcaagtctacctagcggaatccaacagcatggcgttggaacagttaaggtctattgatgacggtcttcactcagcataccaagcactgtttgactatctagcgagccgacgaacaactatttcgttggtttcgtgggggcctatatttacggcactcgtgaaagcgaccgtggatgcattccttgattatttcaacgcgatcccaactggtggcatgcttaccaaagagcaaaagcttgtgatgcaaatcggtttggttcgcgagaatggtgaagaatattactcgccattccacccaatggtgttggcttactacttaaatctttgtaatgaaatgcaaaaagatgacagctttgctgacttgccaactgtcacgttcaatcgcttggggccaagtggactgcttccgtatgtctatcatcccaagcatgggtttgcctacaaccagcaagtaacagaaaacgggttttgggttaaaagtgtccctcaccagaaaagttgtctgaagttcgttcgcaagctggttaaagaaaagatcaacgagttccaaaaagcgtttcgccacttgtttaccggctcagagaagagtgtgttggtgaatgccgtgaatcaagatcgtgcagaagagttattcctcggtttggttgactatgtaaaagataacctcgataaagcggcatcaattcatgtcaacctctacgatgatgagctggttttcaatgcatttgaccagtttgcagaaacgttcaattacgaagaattaaagtcttggttggaattggaccgagagaaagtgcgagaaaatgccgacaccattatcgatattctgcgaacccggctaacttacagcaagtttaccaatgctcaaagtgaacgcgaagggcaagcctactcgcacctgtcttttttcagaaacaacgacaacgtgaagttaacgaccttgagcgttgacgacatgcctagtggtattgcgtgtgatggtctgctgacgggcgacgcttctaaaagtgatgaaggctcatacttcactgcatttggtttgcaaaacgttcaatatagtaaccaaccacacttggaaatagcgaagtatgttggctcgttaatagaaccagcatttaagcccagcacacaatacacgggggccaatgctcctgctcttgcggtcagtgaagactttaaatctctgctagcgcgctcttatgacagctcgatttggaccaccatcatcgacccgaaagtgacgctagacttcttccacgccaatcaatgtatcgtgcttattcattattctgatcagtacaccagctcagccagctacgatgcgataaccgtgacggcacagcgtggtttgttcgaaagggtggttgcacaaagtggcggcaagcacattaacgagttcaatgccttcaatggtgattggctactgaagatgttgacttgcaacgacaccattcgcaaagagcgaaactggcattatcggcgcctataaatttgcgacgtgtctggtgcaccaatctgatatcacctgggttccgctctcagttggtgaaatgatccgcgtgtcgggtaacatcggcctgaaaatgaccgacagtgacttctcacgcaatgtgcagagatataaaaaaggcgcgatttcagatgatatactgctggtgggctttaaagagggtaacctttatttgcttcctgtcgaagtgaaagcaggctccacgccagactacaaaaaagcagtacagcaagcgaatgagcttcgccgctatctaacagagcttttgagcgacgagacactggcgtcgaagctataccgaggcttgtttatgcgccaagtgttgatgcaaatcgacaaataccgtctgtacaacgtattcagcaatgactatttcgaagccctgctggcagagaaagaagagtggctacgcggtaaatacgcgattgcggagcttgagaactatccagcaggtctagtggttagccaccttgaaagcggaagctgtttcgaacctggctataacatgcaggatggcgtgttgaaggttgaccttcctatgtctttgctgccttcactggtgcaacacccgcttcaagtattaatgaacgaaaaggacatcgcacagatctgccatgtgccggcggagtatatgttggtggggcagacagctttgaaaaaaagagagtcgctcgttccattagacgttgtggtcgaaaagccagaggatttaaaaccgaacctccaaacagaggagccgtcaaagttagctgcagagccaactccagattatgcgagtgaatgccgagttgaaattggtcagaatacgcttaccggcgaaaaagttttctgggagtacgggcacaaggatttagcaaaccgtcacctgatcatttttggtagctcagggcagggtaagacctactgtatacaaggtttgttgatgagcttggccgatgctcaaattcggtcgctggtgattgattatacaaacggattcttgccgaatcaccttgagccggagtttattgaacgaacaaatcctaaatccaatattctttgtaatgagccatttggtatgtctccatttagagctcaaaagcaagattttggcgggatttttctcgaagagaagcctcatatggtggctggaagggtagcctctgtttttaacaaggtatattcgacaattggcgagcgccagatcgcagtgctcaatgaagtgattgaatctggtgtccaacgatatggtagtgcttatagcttacagaatatgttggatgacctaaacgaggaagaaactgcaggaccagcacttgcaagcaagctggctcctcttgttaagtctaacttgttttcatctgacagtgataaaagttggaatgatgtgtttgagagtgaacatcaccgctcgacaattatgcaacttgcgtcgcttaaccacgatatttcaatgctttgtactgagtttttactttgggatctatactcctacgcatgtagttacggtagtaaggaaaaaccgattcctattgtattggatgaagtgcagaaacctcgatcatcgcctggagagcccattgggcaaaatgttaacggaaggacgcaagtttggggtatccctaattctggcgactcaaacgctaagtatgctgcgtaaagatgagcaagatcgtttattccaggcgtgtcacaagctgatttttgcaccagcaaaaacagagacaaagacgtacgcgaaaattcttgaactgagcatgccaggtacaaagcaggctgagtgggaaaagcaactaggagacctatccaaagggcagtgtttatcagttggctaccatttggataacggtcagttgaagatgagtgttaagaaagtgaaggtttcctccatgttatcccgcctgaacaattctaagggttgagcctggtaggtctatggatcgtagctttctgaaaaatttagttaatttcgtgctggcggcgaggggactaaagggctcctcataatcctttgatgttgttatatgcactggtaatcccccctgcattcaggttaggagaaaattctacttatgcctgcatcgatttttcggggggattaccatatgtcagatcaagtcgcgactaatacagattaccgttgttagtgtgccattttcatgctttgttagcaaagatgcggtgaatatcgacttattattttccattatttgtatactccatatacaaaatcttttaccgagcgatagtttcttaaccccgcaatcccatcctcaacatgtgctgcccaggctttaatcatatccttctgcgtcatctgtggataaagcatcttcaacaccaattctgtagtctgtaatgtctcccccagccacgtaattttatccagtaccagcgagccatccagcttcttggtatcccgctcaggcgaataacggaactcgctctctaccgaacggaaaaatgccagtcgagcagcgacattgggcgtaatccctgtatatcctttcaattttttaagctgctcttcagtctgacgactaagcaccattcgattcgggagcatcagatcgcctccttagttaattcccagaaatagccaggtttcagtgcagacgatttggtatgtgcattaaacacaatctcataagcatgagagatatcatcacgcaattgatcaacaaaataacgctcatccacttccgtatcagtagatagcagcactacctgatggctggcaaacgggaaatagtggttaatcagtttatcccgatgctgagaatccagacgtcctaatggcgtatcgataatcaccggtaaatcacggcctgaggtttttgctaaagcctcaagaatagcaattgcataaatttgcttttcaccggcagaaagcagcttacgttttatgacggatccttgttcatcaatcagctctacgtcaaacgtctctggggtaatgtgcgcactaagttgtaaatcttctttacgggccagtttgcgataggctatttcgaaattcgctgacagtgttttcactcttgcctgcgttaatacatcactgtatcgatcgagtaaattaatcgtttcttgagcgtttttaaaggtgctactcaagccatgctgacttcgggcaacatcatgcattttttgtacctgacgaacgcaatccagttgctgttgcttaattcgtttagcatcttccagcaatgaaagatatttttgccgctgtttttcacgttgcttgtccagttcgcgtagcttctcaaagagctccattaactggtcgtcttccggggcgcgggcaatatttgcagcagcctgctctaactgctgttcagtctctgataactgggtacggtaaagatcgaagcgttgccatgcctttttgctgtcttgttcaatcgactgttggagcataccggcttcacgttcagagatatcaaacagcaaatcgcctttaggcttagttgccatatactcttttagattatcggtaatcgcttcagctgctattttgccagttccctcagaacgaaatgcaatatcatttctgagttgcgttaaaaagtggctcagctctttttcaaagctttttgcctgtttaatctgcgtttcatcagtaatttgttgcagtaaacgagacaaaatagtgggcgcaagcgcataaggtagcggcccatcacattcctgacgcagtgctttttccagacgttccttatctttcaataacgcatcaactttctgcttttcctgcgcttttgtctgggcaaaagcccccccctgagcatttagcaaaccttcataacggatgatatctttagaaataaactcaatccgcgatttggcaaaatcggctctttccagtatctcttcagtctggcaggccaattctttactttgtttttcaagctctgcaatctgctgttgttgagaacccaccaactggctggattgctggcgcttaacaaaaatcattaagtcattacgcagtttggatatcagatccagacctaataaacggcgcactgcggtacgcaaaatattgccggattcatcttccgccagctccgcaattttctcgccatcaaaaaagaacagatcggcaatgccatgcgggattaattcattaagaaacccctggcactgatcgtaatccagctcactgagtggctgtccatcctgttgcagagataggcgatctttcttaccttttttccaggttcgcgtaacggtaaattccgcttcatggccgcccttattataggtaaaggtcaattcgacagcggcttcctcaggttgttcaatatcgtacgcaccgttgtgaattaacgaactaagttgctcgacatattcctgttgttgagtggcaaggccaaacgccagccgaccatatagtgctagacggatcgctgataggatcgacgttttccctgcaccgtttaaaccaccaaacagtacaataggtcgtggattcaaatcgtgtgggcgctttctgggggccagatcaatggtatgagtaccgttaaatacccgaaaattatgtaacactagttgtttaatgagcacgttcgttttcctcctcgactaaaacagaggattcactggcatcgacaattcttcgctgtagaacctgaagttcagcttccagcctggtgacttcttcctggtgaatatcccggtcgttacgtttttgtagtgctgcttgttgctgctggatctcttcgagactgccccagtcctgtctcaggatggtgcctaacttgtcaaagatcccctgacgtcggctcaggccttccatcgatacttccagtttcgattaacttcatgaccatctcaggttcaacatcaaatccttgagatatctgcattagcaagtcagcatcactggcatcaaatcttgactggtcgtctacaacccaatccaaatctttttggtagacctcccgatagatacccggcagggcatcataccaatcgggctcattcggatcttttaaccattcctggcgaatagcatgtagttcaggttcagtgataagcgtgatggtgtggccctgagcattcatatctcgctcaatttccagtaaatctttcaaccattgctgacgatacttcatccagtaaggtcctggaacatgcttacgttcagcacttatttcctcgccatctttggcgtattgataactgaccttgccgctacggcgcttatagttacggtaagtgtctttatttgctggatcagtggtgaacgccagaagatcgcgatacttcagtaatggagacatccagacttcaccattctggatcaggctttccattgctttatcttttgtaaccacggtacatgtccagcatccaaagcgtgaactaccgcaagatggcgtactgtcatcgataacgagtggacattcgccttgtgctgaagagtccatgtacagtgtccacaatggacggttgttaccaccccatgggttttcccactcatcaatatcatctggagaataacggaatgcacctctgagtaatttccagacgtcttcagtgtcccaggtatcgataggggtatagataaatgcatttgcaagagtggtatgcctcgccaggcgggtaccatcaattttgtgtttggctatgacctgcgcgcgggatgcgctttcgctgctacgtgatccaagtacaacgatgacttcatcaaactggctgactttatctttaataaaatcgcttaccgggttgattttcatgcgctcagtacaccagcggaaactacgggtaggggccggataacctttacctagcagattgacccagaaggtttcgtgggtctttggcatgacagcatgctgagtgattggaagcccagcgcgtttagcaccggcttcgattcgttgcatggtcttcttgatcaaatccactacgactggtgtctctaccaatgtgtcggacgaaacaagaaacacatctttctgccgcatagcgggcggtagtcccagtagtgcaagatataccaaagtaataacagcgctggaatctttacccccgctgtaaccaatcacccatggacgcttatcggcacaatagatacgttgtacttcagatacgtattctgccaggggccgcccggcaaaattttcctggttgataaaatcttcgtaatcggccagatcgtgggcctgaattagtttactcatgagataaccatttgagcttcgagctcttgttcttcatttgaaagggggagcgataaggcgattttaagagcattgcaggtaagctggatagatgccgtcgtcttactgagtttaccatgttgcattgcacgtttggtaagctctgggctgcttttacgccagtcgaactctctaagctcacaaattattttctgccatgagtcagggtgctctgagagcaggcagtgacccagtaaacccagagcctgaagacctatgccgtgtgcatgaacatactcctggcgaagttgagcaggagatacctctttttttgcagctaattgccagtctggcatgacctgaaatatcgcttgccagtagagggccgcaaggtcagagcactgctcaacatcattggctttaggttcttttcccagcagagaaacgcgtagcttgcttgatgctgcttaaggtgaagagtttgtttgaaaacttactgatgctggatttttccatttcagttagtccgataaaaggctcgatattcatagccagataccgtgataagttcgaactgatatctctgtggtcgtaaagtgtagcaagagaagggcttggcctgatggcatatttgttcaaatcagcaaacatttgctgactgcgtttaagcccttcatctacaaagaataatacgggaatattatcttgtcccaactcaggccttgcatccagtgcgtcttctatcgctttcctgcgatgctgcccatcattgattaaaatttgtgcctccatgggcacccgcaaagtccctaagttattggaacccgaatactcatcgaactgcacatctactgcaatggaagcagttagagctgaaaaaacataatcacttggattttcaagtaagtagcggaccatttcaggtatacgggctttgtttaacgttctttgtgcgcgcaactcaggtggtacttcattttcgtcaaaactaaaaattttggggattatacgcattgggcaggtagcgatataaaacggtcttcctgcctggattcctctgacagcggggaaagagtagcaatagtcagtgtcgaaattcgccatacagaggttacctggaagtaatattaattttacgtaaaaataaacgttttataggcttgtgtcatctttttttacgtagagttttcgcttttttgggcgttttttcctgaatttggtgcgggttttaaatctatttgattcaatagcttatctgaacacctaaatcgtaagcttaacgttttaggagcgttttacttgctcatttaaacctctcacctaaacctaactctaaccctgttttctcttgtcctgatgagccttgcaagctcaaactaagctctccgcacacccaaaaaaacactcaccatcagtgactttccccagcctctcagctcccatccaacccaccaatcccttaccgatacaacgatgctttccccacagatcaaaatagcgctatcttcgccgcaaccacttaactcgcagcctgcatcggtttgctaagcagcgaattaggttcttgtacgtcctgtttcagttcctgctccagcgccaaaaaaaggccttcttcatgtcgctggagatattgattttaccgacgccataacgggtcgtttccgcgacctcgctatctttgttgcccgagccgccatgcagcactagcgggatattaattaactggagaagctcactcgctgaagccatgctggataagaaggtgcttcaggtggccctgggccgaaagtttctgacgacagacagaagcgggaatccgtggaagttatgtgtgatgcaacgggtctgtcgcaacgttgtgcctgcaggctggcagacctgtccctgtcaacctgccgttattcggctcagcgtccggctgctgacgcgcagctgtctttacgcatcacagagatggcacttgaacaacctgacatggtcgatggattttgtcatgaatgcacttaccagcggccgccagattaattgcctgatctgcgtggatgatctcacgaaagagtgtctgacgatcaccgccgctttcgggatgaatgtctgaatgagcactggttcagcgatgttcttcatgcccggaaaatcattaatgactggcggcaggactataacgagtccagacctcattcatcgctgaattaccagattccagctgaatttgcagcagactgtagaaatggaaaatcagaaggtaaacaaaccgacattactaactgatcattgtatctaatactgggggcaggttagaaggcccgtacagcaaagcctgagatgtctcgtatccatgataattagccacaaatcatggggtatcggatgggtttataaccttgccgatttgtcccaataactggtgtcctcgctcagatacgcgataccttggctttgatgagttttcgttataaacagtatctaccattccatcgttcatcaggttggttactatcgtcgcaacattgctaaatccgggaataccccgtgtagcaagggtgcgatccagtatcatccatgtccagtctatgtctttttctgccatgattttcaggatgttgagctttgtagtggttaacacgtatttctttgatatcatgagaaattatgtcaagtgtgaatgacgccttcccggaatgttttaaggcgagatacttcatcaagccattaaccaaaaatgaatggctgaaccgccaacagagcttctgaggcggttcctgaaacgactgttatgataaatcggtctggattaaatcttgatgatcaagttcttccagaagtcgagagccttgctctgatatctgatagtgatccatacctgctggggttcttggtattatgtcaactaatcccgcttcggataagcccctaataagccgtgcaacattacccactccatccatttttcgctttgacatagcgcgatcaagattataccaattccaatttacgtcatttcttgaagctaacagcttaagaatgtttagttcagtgttgtttaccatgatggggcatccgaatgataaaggtcatcgccagttattctataatcttcgagagttgcagtgtgcgtgttgttccataaatcataagattcaatgtcatcggctggcctgcctgtttcccaacctaaattacagtaacgctgatattctcgacactcatgagtatagtaattcaagtctactttttcaggaggtatttcaccgtttgcaatttttttcaatctggaaaccataaagtcgttgccaggatcgggatcaaaccgtgatatgtgtttttctacgatttggatcccttcatgagtgatttttattccgtctgttgtcaggtgctctattgccccacctgctttttctgggtcaaatgttcttgacgtaaatgtgcctttagccccgaatacttctggtttctctaactcaggaaatcgcattcttcccattgtcagcccggcagcaacagatgcgccggtgataagtaaccctttgttatccatgacctgatcgtaacccgctggtgcattcccgccgagttgctctgcggtcttcctgaatccctcaatattgccgttgtaaaaacccccagcggccagaagccgacccgctgctttactgttgatggtttttgtagactgagcatgttgaatgggtgctgaccgaagaaacgcagtataccgggcgttttagttgatgtgagatcaggtagctaagccgggagtggagaaacaaaggcaggtcattccggaggttgccagaggatgtttgcacccccgtaatgacatgaccaattgcgtcatttcccagtaaaacaaccttcccggatcgaatgtcatccagcacgtcccggtatgccatccagggctgctgaaagtggaactgacgatatcggctgacaaaaagaccatagttgcccggtaaatcccactcccggatgattctatttggccgagcggtctcctcaaggtaacgcactgccatatccgggtggatgatgtcgggaaagtcatcaaggtagatatcatccactgattttgcctgatagtgatgaagcataatgtccctattagcgctaccattgcacacagcttacaaaacgaccgatgttgagtgaggtttaagactatcccttcatttaagaagagtgaagtgtctggcgatatccaggcgactaatcaaaaggtattttgggattacatgtaaattattgtctggcacctctgacagagaggtcatagaggaaaaatatcaatcatcctggtggtgtttacaagaagcgcctgaacccgaagcgcgatcgcgccattatcctggcgaaaggtggggagcactggtttacacgttcctttatgccaaacaggatatggcaaatattgataatcgcgagctggccggatttcgcgagttagcaaagcactatgctactcttagcgatgaaaagatcacggtactgattaagagtaaagaactggtggagatttgccatgactgcaaaaagtaaatttaagagtcctgcatttgaggccatccacagcgcggcttctggattattaagcgtcgatgctatcccgcaggaaacgatgcgcaactttgataaagcgtgcctcaacaatgtggatgagctgcaacccatcgagattaaggcattgcgtgagaagctgaacgtcagccagcccgtttttgccagctatctgaacaccagtgtgtcaacggtgcagaaatgggaaagtggggtaaagcgtccaggtggattatcgctgaaattgcttaccgtagtgcagaagcatgggttgaaggtattagtttgagtgagttgtactggctgcagcattaaatggaaatctgagtgaatcacggcgcagaaagagcaattttaacctcgataattgggagaaatcggctttaagccatacaatgaagaaattgaggccgggaaaattcttaaatttattgaaccacaatctcatgagcaacaatatgagattgtaaggattagtgcagtaacctggggagaatacaatgaggaagaaagttaaactctccctgataactctttatttattgagtcaggaagagtagctgttggtgattttatgatatccgggactaatgttattgatgttttttcctggtgcgcttcttattattttctgccagctaaaacttacgctttatattaaaatgattttatagcttacttatttaactctgtttttagctggacttttcttctctttcctgatgatatatacaggtatttagcgcggtgcggatgtgcgccaacacacccgcgccgctaatcacaatcactatttagaaggaatagtaatcatgactgacgcccattctattgcacaaccgactgaaccagaagtctctcctgcaaataaccggcaattaaccgttagctatgcaagccgctatccggattacagccgtatacccgccatcaccatgaaaggacaatggctggaagctgccggttttgccactggcacagcagtagatgtaaaggtaatggaaggctgtattgtgctcaccgcccggcaggagagcgaaaactgatgcagtctctgcgccaggtatgcaagctgtcggcgcggaaacaaaagcaggtgcaggagtttattcaggtcattgccggtaaacagaaagtcgtctgaatgaaaagccgctcccgacatcgcatcgggaacggttaactatcaggatgcgtaaagtagaacgatggaatttcagactacatcctcgcgagcctctttaacctacggaacgcttaacatcaaaggcgtcggccggttactcgctgctggcggtatctgtaacgataatagtgaggggtttcgtataacgctgaacagtttggtggcgatgtcttcagcaactgattagtgtcaggcggggaaacccccggttaacctgtatcacagattagataatagttgctttagtcaattcaacaggaaagcttgccccttaaaattataaagggcaataattaaactatagttaattgatgtttttcgtattttaatataattatcgtttgagcgcttattgcactctgtacccggtacctgaaatatcagataatcgcgggtgggttttccctggtgttgacttggtctttgacctcctgaccgctaagcatggtgagtgcccggtggtcaggtacttttttaagtatagggtctgcgcaggtgtaataaaagctgtcttaaaagacaggggtaatggttcccatgtgtgattatcaggaatgaatgaatgaattctgctattgagttttttttgcgtgattacaatgaatttccgccagaattagcaaccgaaaactctaccggctcagaagaaaaacatttcgtgacaggctcgactggaaagtcgaatgcattgacggcatggaaaaggatcaatttgacaacgaaaatacgacttacctgctgggcatgcataacgggaagttgctatgtggtgcacggtttatagattcgacgcagccgacgatgatgagcgaaatttttcatgaatatttcgagggtataagtggtctccccacagatatcccctgttgtgagattagccggctgtttttagataaacaaagacgtgactctgcaggccttcatggcttgcccgccagtaaagtgttattccttgcaatgattttttattgcatgaagagaaactatcgggggatgtacgctgtggcaagtcgcggcatgtatgcaatatttcgccatgcgaactggaaaatagaagttattcagaaaggcctttctgaaaaaggggaagttatctactacattttcatgcctgccagcatgagcatcgtggaagatattatcaccagggacaaagccagtggctggcttcgtgagatgtcccggcatttacgccatctttaacccgtaacgctggctcagttgtccagcagccggagctccgtcccaagttttaccgcatgtgtggcgttattcactccgagctttttcatgacgttgcccatatgaaattttacggtgcgttccgcaatagataaaatgaccgcaacttcggcgtatgttttcccggcgccgacccacttaagtatctgccgctcacgcggtgacaaaaaaacgttctttttctgattgtgttgactgtataagttaagcgtcttctgatgcaaattaataagaaagctaactatttttgaacgatttttttccatgtcgataccagaatctttctgactgataatggatagcaaagccaggttgttcaggtagtcatgcagagggaatgtctgtccctggaaaatattatattgaaagctttcattaaaaattcgcgtgagattgtagccgcctgacagaatgacgttgttttcccaaaaaaaatcttcaacacaacgtaaactctgaataatgacaggatcaataaactgatattttctttcaaggtatatatcgaaccactcagggttgttattaataatacgcatctgtgaagggtctttcttgttcataatggcgtaggcatagataatacccttgtaatcctcaaagaacgcattcagttcactctggattaacaaattgattcttgtatcgttgtagtatgtatccttcacgtcagtatctacctccgggatgagtggataaaccagtataatccgcttcgttagctgttgctaatcgtattttaatccagttaaaggacagtgcaaacgacatctgccagaaatatcctgaatatttttgctttacaaaacggatggaaagagcagtttacaagattacagatgaattatcgggattcacaaaaatctgcggggacagcaggaacattcgtataatgattcgcgattttaagttattgctgactggagtgaaccgacatcagcatttttcataacaaaactcatgctggcaggcgtaattaaacagacaccgagtcagtatctgactgcagatggtttttaaatcctgatgctcatgctccccttcggctacccagcgttaccgggtcgtcagtttctgctgcgctaacccctgtgggtttcggacataaggcctgatggcaaacgttcaggtcaaccctgcagccggcttaacgcctgcgctttcactggccatatagatgatgacaagcgagtgttaatcagcatgaggcacatcaggtcgtgtaagtaggccagtaatctgattactctcctgaacagcaagcctctattttagctcactattggttactactggtttatgggattgataagtggtttttctatcagaggccagggcgcatggggatgtacaggggcaataatatgttgcaggatgtccccatgctttatcagataatcgtaacagggaaggggcgttaatcatgaaaaacaagatgatgctgggtgtcgtatttctcttaacgggatgccccgggcctggcgaccgaatggtggagcgcgaatctacaacggcatttatcaaagacaagcaagtttgtgtggtgtcgccactggagccacaagaaaggattactgccattcaaatcaacagcgataaaagcaactctcttcacaaaatttttgatgacaagcctgtttatattccaaaaggtgagtgccttcctgtgtttggatttaagttcacaactggagagcattactatttcgcctgtgatgttcaatctgataaatcagcgtcgcatttagtcactgctgatttttcttatccaaaagaataggggggcataacggccctttgattctcataaatgcacgcatgtcatcaggccaggcttaacgacttcacatctgcggtagttaaggtagttaccaatgatgggacatcactcttattcatgggggcgaggcaatgaaaaacctgtttaagtggtccgcacttgtggctgccaccgtcctcattcttattggcttgtttgtctggcttgttgcatcgggctctgatgaaacgactgtctacaaagaaaatgactttttcagctatcacacactgacagacaaggacattgaaaacgcgccgcgtataacggacaactactattttgaagcgcaccctggcgacggttactcaccttcaaatagcatcatatttaagggggctacagatactgcatcgctgcgcgcttatctcgaaaagttgggatacgtgaagcaaaatcgcagtctgggcgagaaggaaatatgggcaaggcctgatcagttggatggggatctgttctatctgtactttaatcccacaacccgtgaggttgagctgaccagggttctgaataattgagtcgcctgaacgggaaattgttacggcgatgccggtctctgccgctggtcatcacgctgctgctggtgggatgcgcccgctctgacgcgctgtggacggtcacgcatgacctctgcatgaataactatcactatcgtcgcgatccggcaccctgccagcaaatctatctgccgcaggacagcacccagggctacagcatcatccagaatcctcgccacaggttgcactttattctggtgcccacggtggcgatgtccggcattgagagcattgcgctgacgcgccccggacgtcccgattatttcggctacgcctggttaatgcgctatcgtctgatggcggcctatggggctagggtgcctgaggatcggctcggcatggcgctgaattccgcttatggccgcagccagaatcaactgcatattcatctgacctgcctgcgggaggatgtctatcgccagcttcaggccgagcgcccctatattaataatgactggcgacccttgcccgaccgtttgctgaatcacacctactatgcccgtcgcgttatgcagccgacggcgatggggatctatcctgttgcctccgtggcacgccatttccggctgtcgccgtcgcagctggcagagtctggcgtggcgctcattccggcgacgttttcgggagagaaagggtttatcctgctaactacccggcgcggctgggataagggcaatcgggcgtccgttgagtcgctactcgataaacgctgcgcaattctttcaacaccgccagctgacgtttcagtcgcgaagtaactaaaccttatcacccttaatcctccaccgacccagccactctgctgtaatcaaacgctctgccagcaagaaacctggctgacggggacgatcgcccgtgcatcggtttcgtaaacattgaatcaggttcgtgtccgcccaatatagtgagatcgcatagtcatttatcagaccagtccataggtgacaataagtgcgaaacaaacctcaggatactgcccgcaaaataagctctgatgtttttatagacaaacccaagctagacttaataaaagttattaactgttattaaaagaggtgatcactatgggttctcttacaaaacagaccattagcgcacagatacccaccgatttggctaatgctgtagaaaatctggctgtggagctggattgttctaaaagctggatcatcaaggaagcgttgaccactatgctggctgaaagggaacggcgtcatcagagcattcaggctggtcttgccgatgtagatgccgggcgtgtagtaagtcactcggaccttgttgaatttggtaatcgtttaaagaaaagctgataaatggaaatttactggacgcttaaagctcaggatgacctgaaacgcatctaacgtttttctcttcagtacagccgccagcatgctgatgatgtcttagaccgcctgataaccggcagtgctggcctcaaggcacacccagcaatcggcatacagcaggttcgatatgaacctcgggacgttcgaaaggtgatactggatgactacgagattcacgacgaacttcgtgataatgccatctacatcgtggatctctggcatacgaaagaagagcgatgagcagatctcttttcgttgatggctcttgcttactgacctgatacttatttaaagctcacttctcaaaacccaaaaaagacaccgatccatcagtgcctttcccatactcaactcgcaaccaatccctcaccaaccccttaccgatacaacgccgctttccccaccgaactaaacagagccatcttcgccgcgaccacttcactcgccgcctgcatcggtttaacaaagagggaattaggctcgtgacccccaagcttcagttcctgctccagcgccacgaagaacgccttcttcatatcgctggagatattgattttacccacgccataacgaattgactccacgacctggctgtctttgttgcccgaaccgccatgcagcaccagcgggatatcaaccaccttacggatctgctgcaggcgctcgatatccagcttcggctgcttccctttggggtagaggccatgcgaggtgccgatggcgaccgccagcgtgtcggtgccggtctcgcgcacaaaggtctcggcctgctgcggatcggtatagagaatctcgttactgccgccttcgccgctgccttctgccacgccgatggtgcccagctccgcttccacagagacattaatcgtgtgcgctatctcgacaatcttcttcgtcagcgcaatgttctgctcaaaagggtgagacgaggcatcaatcatcaccgaggtaaaaccggcgtagatcgctttcatcacctcttccagcgagcggccatggtccagatggatcaccaccggcacgcgcgcctgaatcgccagcgtccgcagataaccgataaattccgggccggtgaaggccatctcttcgggatggatctccagaatcagcggtgaatccagtcgctcggcagtctcaaccgccacccgtccaaactccgcgctggcgatgttaaacgcaccaacgccaaactgatgctgtcgggcaacgctaagcagatctttcatgttgtaaagcataggttttatccttgttttgcaggaacggagatatcttttttcaggaacagcaggatcagcgccgtcagcagactgcctgcggcaatcgcaaacagataacccatgacattgctgatcacgttaggaatgaagatgacgaaaatgccgccgtgtggagcgcgggaagcgcagcccagcatcattgagagggcgcccgctaacccggagcccgccacaatggccgggatgacgcgcagtggatcggcgaccgcgtaagggattgcgccttcggtaatgaatgacagaccgaggatgtaggtgaccttgccggtctcacgctcctgctcggtaaacttgcggcggaagagggtggttgccagcgcgatgcccaatggcggcaccatgcctgccgccatacaggcggcaatcggtccgtaaaccccgctcgacatcaggccaatcgcaaacatacagacggttttattcagcgggccgcccatatcaaaggccaccatcatgccgaaacagcaggccgagaatggccgcattggtgttacccagcgaactgaggaaatcggtcagccagccgagcagcatttttatcggctcaccaatcagcagcgccatcagtgcgccggtcagcagcacgctcagcagaggcacgattaaaataggtttcagtccggcgaccgctttgggcagatggatatggttattgatcagcagcgtgatgtatccggccaggaagccggcaatcagcgcgccgagaaagccggagccggtgtggatcgccatcatcccacccacggcgcccgccacgatgcccgctttgccgctgacagactggctgatccccagcgcaagaatcggcagcatcagcgcaaaggcggaaccgccaccaatgtcagagagcatcttcgctatcgggctgaagttcgcgtcccctggtgtggccgccgtaattccgaatgaaaaactcagcgcgatcagaatgccgcccgccaccacaaacgggatcatcaggttcacgccggtgatcaggtgcacataaatctctgaaatccaggaacgggaacccgatgtctcacgggcactgttagccggttcagatgcactggtctgcggcgcagcgtctaccagcctgggagccagctcgccgttaacaatggcgtttaacaggccttcagcgtccttcgcggcacgggtaacgggcacctcaatcacgtttttgtgctggaagcgcgccatctcaacttttttatctgcggcgatcaacacgacgtccgcccgatgaatatcgtcgtcgctgaaaatatattcgctttcaatcgcaccctgggtttcaactaatacattcaggcctagttttttagccgctttttttaaattactttcggcaaggtaggtgtgggcgacacctgtaggacaggcggtaatggcaataatgttcataaatgttctccagtgaaaattttatatttatgtttttcggtctgaagggatggctacaacctggaatacctccttaattttttaattcatgctgctctccggtttattcaggctcccgatcgggataagagtaaatgaaatatctcttcgcgatgcgggacattaagtaattgctcgacaacatcctcatcgcctaacgcaatggatattttggcgagcattttgatatggcccacatctttatcggactcttttactgcgaacagaataaccagccggactttagtgccgtcgatggtctcccacggaatatcctggcgtaaacgacccacggcaatgcgggttttggcgacggcggcagatttaccgtgtggaatagcaatatggttttcaaatccggtagagcctaattcctcacgcagataaacatctttcaggaaagcgactttatcggtgacggcgccggtctggcagagcagatcggtcagctgagaaataatctgctctttggtctggcaatcgacatcgagaataatgcactcttcttttaatacttcgttaatagccacggctgtcgtcattttgcttctccattatcattaattaatcgaattcgataccagacactccgttacccgagcgatatctttcgccgagaaacagggcagagacatacaccaccggtttttccagcggttccagccggatggtggaaatcaccacgtcacactcatgtcgtttcagggagtcagcaatatttttccctggcacgatgtcgataatcttccagtcgggaaaggcacggataatgcgtccgtaaagcagctgcgaggtgcccagaccgctggagcagaccagcaatacccgttttaccttgatgctgttttcgatggccgcctgaatgtgcaccgtcagataagccacttcgtcatcactgatctcatccaggctgtactcctgcgtcagctggctgattaccgctttcacggcggcgaacaccgtgcccagctcggtctggatatcatgcagcagcggatttttaatccggatgtgatatctgaggcggttcagcatcggcttgatatgcgaggacagtgaagcctgcaggttctggtcggtagtgatttcgatgttgatgcgctgcgccacccgggcgatcagcgcctcagcaaagcgggtttcacgctctgaaatcagggagtcatcgtgctgtggtgactcaccgcccgccttaccggaggagaccagatactgatagatggagtgagactcctcggccaccagtaccgtgttgtaagcggtctcaatgcgttctatcaccgccagtgacacctgccaggcgtgatggtcgctcacccggttcatcgacaccgcgcgggcgtcggtcctgtgcatcggcgagtgactgcggtggatcagtaccagaatatgcgtaaataaattgatgtagtaaggatcgcttatcgtatattgcagctgctgttcaataaaattaattaattgcagggtaaaatggacagcctgctgaccaaacttctctgaaagctcctgcagcgtgctttcatccagacggctttccatcatgtcctgacggttataaatcgattttaacaccagcgctttcatcgccatgcgaatattatggtcgctgccttttatgctggttccgacgcggctttttaacaaggttaaatcaaactgatgtaaccatgcttctaatgtttttaaatcattcactatcgaggcgcggctgataaaatatttatccgccagttcgctgatggaggaactttttggtgacagcattaataaatcagacgctattttcagcatcctgaagttgctgctgaaatcatccacctcggttgagaaaatccggcgcgcggctatttccgactgcgcatcagcgaatttaattgtgatccctctcccactttttccgctgaggttgattccctggtcagaaagtttatcgttaatgtcggcaatatcgcggcgtagagttctggttgttatagacgttttttctgaaatagcgtgcaggctcacataactgttatgagaaataagctgtcgcataatcgtcagttgccgttcagtcagcgccttcatcatcatcaggttccgcttaatccgttattcgccttgtcagttatcatctaaacaaaggcactatgccatgtaaatattaaaacatggccacaacctggtggtcaggctgaccacctgacagtgaatttcttaaataatcggggacgaggtgaaagaataagtgaaaggggatgggagggtttggcgggctgactggcagtgatccgattggtgggactacatcaatggctgagggcagaaacctggcgggaaagcccggcttacgccgggccaggttttatctttacgccatcttcaaacgctgcaatcgtttctcgcggcgaatcttgcgctcttccatcaccgcaaccagcgccatcaggcagatacaggcgatagcggcggcatccagtgcggcaaaggtgcccgcccagccggtcaggccaaatatcggcgtgccgtcggcaatcatgcccaggcccagtttggcgaagctgtcaccaatcagataggcgaaagtgcctttgatgccatccgctgcgccaatcgcttttttcggtacaaagccgactgcggcgacgccgattaacagctgcgggccaaagaccaggaagcccagggcgaacagcgacgccagatagacatactggttgctggcatgctgatagatcccgagcgtggcaataatcagcgctaatgcaacgcaggcgaccagcgcacggcggccattggccagatcggataaccagccccacatcaatgtgcccaccagtgcgccgacttcaaacagggtaaagccctgaatcgccacctctttagagagcttcagctcctggaaggcgtaaaccgttgaccactgatcgatcccgatgcgcaccacatagaggaagatgttggcgaagcagagcagccagatcaccttgttcttcagtacgtactcgacaaagatctgccatttggtcatcgactcatcttcagcttctttgtcctcatcgctcagctcttcgtcaaacagctcttcggccttgcccaggccataagactccggagagtcgctgccgtagcgcaggccgataaaaccaacaatcagcgcgataatagacgggaagataaacatcccaattacgtggccgtcgaacagcacattggcgccaaacagcgcaacgcccgccgcaccggcaccgccgaggttatgcgagatattccacatgccaagataagtacctcgtttgcggcgcggcgtccacttagtgatggtggagtagctacaggagccgccggtactctggaagaatccgcttaaggcatagaaggcgatcatcaggaacaggctgacggaaccggtgcccatgctggcgctgaaacccagcatacagatggccgagaggatcagcataaacggcaggaactgcttggtgtttttgccgtcagcataataggagaccagggttttcccgacgccataggtgatggagaagcccagaccgatcatccccagctgcgtcatgctcagtccgtaggtggtgatcatatcgttctgcgcgatattgaagtttttgcggatcagatacatggtcaggtagccgataaagaccaccagataggactgcataaacggcttgaaccacatcttgcgccgcagtttcgatgggcagatccagcgtcggtctgcgcacctgtttgaggaatgccagcatggaaggggattctcctggttggaatagctgcaatgggcagcgaatggctggcattgtaaaaacctgccgccagactggcctgagacagcatccaggcgaaaccaggaaaatttcttagttttgccccactcggggcaaaaaggagaggcgtatcacgcttcaggcagggggcgcggtgcctgagcatttaaaaacggcagcagcagcagggcggatatccccgccgccgtggcaatcaccgcaaagaagccgctccagtgccagacgtcgataacccacgccagcggccagccggagagtgacgcaccaagataggcgaaaaggccgacgaagccggttgccgcgcccgccgcatctttatgggaacattcggctgccgccataccaatcagcatctgcgggccaaagacaaagaaaccggtagtaaaaaagcaggctgcctgcatcacgtaactggtaaacggcatcagccatagtgagccgacggaaagcaaaatcccggctgcaaaaatcaggttcatcgggccacggttgccgttaaacagcttgtccgagccccagcccgcgaccagcgcacctatcacaccgcccagctcaaacagggtgactaccgagttggccgtgaccagatctacccccagcgtgtcggagatgtagagatttccccagtcattgagcgcagcgcgaaccacatagaccagcacgtaacagagtgatagcagccagatatagggattgaatagcacatagcgggtcaggatcgccttgcgactcagacctgcgccttcctgctgctgcgccatctccatctcatcctgtcgccagtcgcctaccgcgggcaggccgacagtctgaggccggtcgcgcagacgccagcagagaaacagtccggcgaggatcgctaaactgcccgcaatcatcatcccgattcgccagccatagtgcagcgccaccgcaccgataacgatcgggataaccgcaccgccaacgttgtgcgcggtgttccataatgcccaccagccgccgcgctcgttacgtgaataccagctggtcagcaggcgcgcgcagaccggcgcgccccagccctggaaaaaagcgttgatggtccacaacagcgcaaaggcccacagtgaggtggaaaagccaaacaggatattgaccacgccggtagcgatcagccccagccccataaagtaacgggcgttggagcggtcactgacgatgccggagaagaacttcgacaggccgtaggtgatgtaaaatagcgtcgccagcaggccaatatcggtgcgcatcatcacgccgctggcgatcacttccggcgccgccgcattgaagcttttgcgggtaaagtagaacagggcatagccgatccagatggtcgacatgatgtgccgccgccagtagcgatagcggctgtcaatctcacttttgtcctgcagcggagcggcgttagcgggcgttttcagaaagttaaacacggtgattcctcaggccatacgcagcggcagatgcacactgacgcgggttccatgggtgcaggagatagtcagcgatccgcccagcgcactcacgcgttcgcgcatcccgaccagaccaaagctctgctgaccggaacctggcggcagaccgcagccatcatcttcaatcaccagcaaaacgcgaccattctgttgccagcctttgagcatcacggcgctggcgctggcgtgtttcacaatgttgttcagcccctcctgacagacgcgaaacagcgtgacgcgctgcgcttcgctcagcagcgtctcatcaatacgccactcaaggtgactgacgatgccgcaatcctccagctccatctcacgcatcagggagcgcactgcctgttcaagtgacaggtcatctagctggcggggtcgcagacgtcccagcagtcgccgcactgaatcgtagacacccagtgagagctgctcaatatggacgccgctctggatcacccggccattatccggcgcaaggcgctgcacaatgcccgcctgggtgcggattgctgtaatcgtctgaccgatgtcatcgtgcagctcgcgcgccacctcctggcgcacgttctcttctgtctcgaccagccgttccgccaggcgccggttgcgtgccagctcactctgcagcgactgattcagctcgcgcagccgctgaataccggcacccagcagcagtccggtcaggctttgcgccagcagcgagagcagaagatcgaccggatgatcgtgccaggtctggctggcgatcagcgcgattgcgttcatcagcgtcgcgatcagcgcaccctgccagccgtagtgccaggccagcgcaataatcggcagcgccagacagaatggcgtaaagcgcgacagttcagcgggcaggccaagctgcaaccacagactgatgacaaacagcagcagataccagataagatgccgggcgcgccagttgaccggttgcgagaccagcgccggtcccagcggctgccagcgggtgctggtgaggtagtgccagatgaccaggcaggtcggggccagcgtcagaccaccggtgagcgtcagcagcagggcgttcagcatctcctgctgtcccgcccacgccagggactgcagcagcgccgcggcgatcagagccgcgccctggctcagcagcgtgcgccagtcacgctgatggcggtaatgggagatcagcgccaccggcagcagcgtcagtacactgcccgccattaacagcggcagatgcgccagcgcgaccaccttcgccagccagatcagcatgatccactcagctaccagcaacaccggccagtaagcgcgtggacattgcagcatcagccccagacgcaggccaaacggaaatagcagcaccgccagctccgggcgttccaccaggtgcaggctgatactccacaggcagaaccaggccgccgagaagatgaaaaagctggcgacaacggagatcagccgcgaaacacagaggctcattgccagccatcaaacatgcggcgcgccagctccacatcattgctgacgccgagcttctccatcagattcgcgcgatggacatgtacggttttcggtgacagcgccagctcaacggcaatttcctttaccgccatgccctgtgacagtttttccgccacctgacgttcgcgtcgggtcagcgggtcctgccgaccagcggccagcttgatcgcaatctctggcgtcagataacagccgcctgtggagaccgtgcgcaccgccgcgatcagttcatcgggacgacagcgtttagagaggaatccgcgcgcaccggcattaagcgcctgctccaccagggccggactgtcatggactgacagcatgatggtggccaggcccgtcggcagcttgctcagcagctccagcccggagagatccggcatcgaaatatcgcagatacagacctgaacgccccggcccggtaaacctgccagcgcctcacggccagaaccaaattccgctacgacctggaaatccgattccaggcccagcaactgggcaaagccggagcggacgataaggtgatcgtcaataagcgcgatggtgatcatgtttattcctggcgggtaaaatcgcgcttaccttagcgataagcacgaagctgttcaagtcgtgagcagtctattcaggtaacggtgtgggtagggtgatgcaggtcaaactgtcgtggatcgtgagaaaagcatgccgggctgaattgccgcccggcagatcgtgaggctaagcagtcgatcagtgcagacagcactgcttatattttttgccgctgccgcacgggcagggatcgttgcggccgggcagtttctctgccgcgacaggcttctggggaacgggaatcgcttctggctgggagatccagtgatcgtgtagcgccagcgcagcaggacggatagcttcaatgctggcttccatctcgtccggcgtcatggcatcgatcttttcaaggttctcttccacgccgtgcagagcgatggcgtccagcgcgggttgcaggtccttcggcagggcagaccagtcggtcagcgcgacaccgcgcatgtaaccgaagcaccactcttccaccacggtaaattccagaccttccatttcacggatgccaaacagcggttcgaactgctcagggaattcagataagcggtcagccacatcattcatatgctggaagcaaagcgacataaagcgcgtcatttcacgctcgttgctccattttgggatctgcttctcgccaccccacagtgccaccagccactggcttggctcgacggtgacgggaccggagagaacggcagtcagcaggccgtcgagctcggagacatcaataatcgatgcttcgctgccatatttttccagcatatcttccagccattgcagctctttttcggacagtgggccttctttcatgcggttgcctcccgggcatttcaaaatttcagcggcgttgagccttaaaaccgcagcagtgtacacccttgtggactgcaacacagctaaccctgttcgggggagctgcggtgattaaaccgcgtttagcaccactttcaccccgttgtgcaggcgatagcccacagcactttatggtacatttttgcgctccagccagacagttgcgtgttaaataataataagttaatgattaatatatgaaaaatggatttactggcaggccggctgttgcagtctcccttgcacggctgacccctggcggccagtggatcagcagattaatgacgcgattcatgccagcctttatcttcctgctggcgggatgtggaaccctgtcgcaaacctccgccccggtgggcgaccgcgtttatctgacacacgccacctttcatgaaaatgtcgacgacatcgtgcagcattacatgcaacagaagcaggttcccggcatcagcattgcggtcattcatcgcggtgggccgacccgctattacgcttttggcgtcaccgatcgtgtgcatcgctatccgatcacgcccgataccctgtttgcactgggatcgctgagtaaaggcgtgacggcagaagtgattatccagctggttgatcagggtaagctgcgctggagcgatacactggccgatcttctgccggaaggcgttcgcctcagcgctgacgcgcagcgcatcacgctgctgcagctggtgacgcacacctcgggtctgccgcgacaggatatggatctgacgatgctgcagcagttcgttcgttatctggacaccggcgagaacttctatggcaatcttgatagcgacaagctgctgagttatctggcggacttctctgcacccgcggtacgcatgccacactactccaacctcggctatgcgctgctcggttatatcctgcgcacgcgttgtcatcaggatattcagacgctggcgtcacagcttatcttcacaccgttaaaaatgaaccaaagcagctttgtaccggaaacgctggcgggctatccattgcgtgcgctgggccatgcaggtgatcagccaaaattaatccgccgcggcacgctgacgcctgactggcattttcacggcaacatggtggccgcggccagtctctacagtaacgcgcgcgatctgagtgcttatttgcgcgcacatctcagcgctaccggtgatgctgcgcgggaccgggctttcgcggcggtagatcaggcgtggtatcagcagggcgcgcaggcgcagaatatcgcctgggtgaccgacactttcgaacagcagcagatcacctatcaggtgggctatatcggcggctatgccagttttatcggctacgataaacgtaacggcaatgcgattgtggtgctgcagaacggctttaactggagtaactatttaggcattgcgttgttggtcgatctggcaactcaggataaagtggtcggacagtgatccgctacctggcctgtgtgcagtaaagtgaatagcgctgtttttccttacacatagcgtcagtgcgccggaactgaagtgcgataaacattgtctttagcctgactgtcaaaattcaacgtggaaatcattatgcgcaggactcaacgtgtacttttatcaatgggattactggttggctcgctgagcctgatccccgctgtacaagccgctggcgaagcaacggataccgttccgccaccgccgcagattcagcctgctaatccggatgcgcagcccgctacgcctgatacgggcagcgttcagccggatgccggtgccgcgcaaagccaggcgccgaccagctcacaatctaatgatggtattacgccgaccacgccagcaccttccaacggcgcgcaccctaattacgacctcagcaccatcatcatcgactacaaacagtatcaaatcggtgacacagtgccagagaagtacaccgataaaacgtacaccatcaatgagtggcaaaagcgtaatctgcctgctccgcaggaaaacacccactgggcctatatcaacgccaattacattcttattactaatgacaccggcaaaatcgtcatgggtaaatcgggcgatatcttcttccgcggttaaaataagcgcggttaaaataagcggtaaaaatcagccggtcgtgatgaccggctttttttagctgaaacgctcagcaccaaagcttgccagcatcggatgcttttcaccgcttacaatctcctccgccagtaattcaccgacaatcagcgccagggttgcgcccgaatgcgtgaacgccacataacagcccggcaccttctgcagttgccccagcaccggatcgccatcgcctggaatcggcttcaggccaattttccagctctggacgctgagcggctcgtcaccccgtaacagctgactcgcttcctcggccagctttgctacaacctgcttatcaatatggtaaccgcctccggccagcttctggatatcagcctcgtaccagtcgtgatccagggcgtaacggttgccggggtttggccggatggcggcgcgaggcgtgttcagcaccgccttgagttcatgtttgcccggctcagtgatcaccagcatggagacgggcgatccgttgggaatcgtcacgcccagtggcgcaatcacatccggtgtccagggcccgcaggcgaccaccaccgcatctgcccgcagttcgcccagctcactgcgaatgccgcaggcccggccctgatcggtgatcacactggctttaccggcgtgttcaatcacttcaccaccccacgcccggaactgattcaccagatactctgacaggtgcggcaggctgacccagccttcaccggggttaaatatcgcctgcgacggcagcgcgtcgggatcgatcgtcgcatccgcctgcgccacgttatcaggggtcatgagttgcgagtcatagccgtgtgctttctcataggcgtgccgcgcctgcgttccggctgcatcattgctgaaccagcagaccccgccatcaaaacgcagccagtcgagggtgggttgttgagcaaacagggtgcgatagcgatcaatgcccgccatgcgcagcgcgtgataggggcgggagcgttcacccgccgagttgagccaggagagtgaacgtcccgatgcgccggaacagagcgcggcttcggtcaccagggtcaccgccgttccccgttttgtcagctccagcgccgtcgagacacctattacgccaccgcccagaacaaccactttcatttcagtttttaccgccattatcagattccttgctcagttacagcacttcagagagaaaacgttgcagtcgcggcgactgtggcgtatcaaaaatggcgcccggcggcccggcttcaacaatctcgccttcgtccataaacaccacctgatccgccactttgcgcgcaaagcccatttcatgtgtcaccacaatcatcgtcatgccgcgacgacagagatccgccatcagcgtcaggacacccttcaccagttcgggatcgagcgcggaggtcgcctcatcaaacagcatgacctcgggatccatcgccagcgcgcgggcaatcgcgacacgctgctgctggccgccggagagatcgcgtggccggtgatcggcgcgctgacccagacccacttcttccagccgctgacgcgcaatcgccatcgcctgcgctttgggcaggcccttaacccgccacggtgccagcgccacgttctccagcgcgctgtgatcggggaagagattgaaatgctgaaacaccatgccgatccgtaaccgcagcgcatctggcttgtcgcgcaacactgaccgatcagccagaagtacatctcccgattgcggttcatgcagccggttgatgccgcgcagcagcgtcgacttacccgaaccggatggcccgataatgcaggtggtgctgccgggcgcgacccgcagcgagacattacgcaacacctcaatcgggccataagccagagtcagatcgcgcagctccaggctggcaccgtgccagctcgcggcagtggtgctgttcaggttattcatggttgcctccgatccggggatgagtgaccagtgcgccgccgggcgctctgacttcatccacctcttttaagccactttgcggggcagtcaggcgacgtcggccggtgcgataacgcacatcgacatagttgaccatgtgcgtcagcggcacagtgataatcagatagaacagccctgccagcatcaggggcgagaggttgccggtgagcaccgccgcatcctggcccacgcgaaacagttcccgttgctgggtcatcaggcccagcaggtaaaccagcgaggaatctttaatgatggcgatgaactggttaacgatggcgggcagtacgcggcgaatcccctgcgggatcaccaccagtcgcattgcccggccataactcatccccagcgcacggcaggcttccatctggccgcgttcaacactctgaataccggcgcggaaaatctcgcccatgtaggcgctggcgatcaggctgagggcgaagatccccagcggatagggcgtaggaccgaacagctgatagctgaagcgcgccaggccctgaccaatcagcagaatggtcagaatcgatggcagaccgcggaacagatcggtatagagccgggcaggcagacgcagccagcgtgagggcgagatgcccatcagcgccagcagaaggccgaatagcgtgccgagcagcgttgccgccagcgagataatcactgtattgaccagcccggtggtcagcatctgcggcagtacttccatcattgatggaaaatcaaagaaggtgcgggaaagaatcgtgagcaagtccatcgccgtctccatgcagggtgggggatcccccggttaactcaggacgcgaacgtccgcatctttactgcccgccaggcagatactgttttggcatcggcgatccggggaaccacttctgatagagccgttgccaggtgccatcctgcatggctgctttgatggcactgtccagcgcggccttgaaggcgggtttgcctttggcaatggcaatgccggccggtgcatcaaacgaggggatgtcggcggcagagaccagcttaaagcggtcggcgtagctttttgccgcctcgtagtcgaggaagattgcgtcgagcgtaccgttgttgagcgcagaaactgcgctgttgttatccgggaagcgcacgagatcggtctgggtgaagtgttcgacggcatagctctcctgcagcgtaccctgaaccaccccgagccggtgttttgccaggctggcgacattcttcacgccgctgtcgtggcgggtcagaacggtgagaaatcccgccagatagccggttgaaaaatccaccgtcttttcacgcgcaggggtgatgccgatagccgccaccgccgcgtcatactgaccgttggccaccgccggcatgatggccgagaagtcctgtccaataaaatcgaccttatcgatcccgatacgatgggcgacatctttgaagaattcgacgtcaaagccggtgaactgaccgctggcatccgtgaaggtgtaaggttttgagtcgccgacgctggcgatgcgtagctgacccggttcgatcagcccatagggattgttatcgctggcagccagcgtacagaaacgacagtgaacagagtgcgagcgtggtgccgagcagtttgcccagggtggtttgcgatttcatagctcatccgtttttgcaggtttaaacatcagagactgttgagccagcgattattattgagaccggtctcaacacaggtgacaccttaagacactgatgttgtgagaccggtctcaaggggttacaatgagtttaagcacagccttttttcggcgtcaatattcctgtcatcaacctgtgattcaaaataattatgaccagccagaaacgacaatctaaagcgcctaccgtggcggatgtggcgcgcgcagcaaaagtatctaaagcccaggcggcgcgtgcgctgggtggctatggggcggtcagtgatgaggtgcaggagcgggtcaacagcgcggcctccgcgctcggctaccgtctgaatgccctggcccgcagtatgaacaccggacgttccaataccattggtgtgattgtcggcgacattgagaatccccatttcggtcttgcgctgcgcggtatggcggatgtggcgcgcactgccggttaccatctgctgctcagtaacagcgatgagaagttgcaggctgagcaggatgcggtgcgggtgatgctggaaaagcgggtcgacggcatcatcgttgcgccctgctgttcagaacaccgtcacaacagtcacctgactcaggtactggaagagggcagagcgctgaaattatttgatcgcgcagtcactgaccttgatgtggaggcgatctgctgcgaatttaccgaagtggctgcagaagcaaccgcgcagttactggaagcgggccatcgccacatcgcttatatcaccagcatggcactggcaaccgactacagcatgccaggcgattttggcctgacgccggtcgcccagcgcgtgggcggcatgatgcaggcatttgctgccgcgggcgtggaatttgatccgacgatggtgaaagtgaatgcgctggacgaagcggagattgcccgtatcgtggccgagctgtggcagcgtccgcagccgcctactgcgctggtggcttctgacagcgtggtggcgatgtggctgctgcgcgaagtgacgcagcgcggactgcgaatcccttccgatctctcattcgtgatgtatgacaattttccatggagtgagattgttacgccaccgctgacggtggtggcgcaaccggtgtatgagatgggccgtgaagcggcacgacgcttgatcgcggagatacgcggcgaagccgtcggaccgatgccgcgctttgatgcccgtctgatgattcgccagtccattgccgcaccggccagcctcatcagtgcggaatgatgcggttaacccggccagcccggtaaccggtatatcgcctgactgatgcgttcgcaggcaatgggtctatcattttcgccagttttggtccttttttatcaattatgatcgtggcaatctgcagagataatctgcagccaggaggcaacatgtcacaacataccaatcagtacggacagccggtcggtgggccaatgccagactggcagccccgacctctgccccagcatcaggtttttactggcgaagtttgtcggctggagccgttcagtgtggcgcgtcatgctgaggcactgtttgaggcatgggcgctggctgaggatgggcgtgactggacttacctgcctgccggtccctttaccgaaacgtccggcatggcaggcgtatgccgcacagcttgaagtgagccgcgatccgctgcattttgccgtgatcgatctcgccaccgaccaggcggtgggtagcctgtcgttaatgcgcattcagcctgaacatggcgtaatggaagtcgggcatgtcatgttttcggcccggctgaaacagacccgcatggcaacggaggcgcatttcctgctgatgcgttacgcctttgagacgctgggttatcgccgttatgaatggaaatgtgatagctgtaacgccccttcccgtaaggcggcggcacgtctcggttttcggtatgaaggcgatttccgtcaggcgatcgtctacaaaggacgttcacgtgacaccagctggttctcgcttatcgatagcgaatggccgcaggtgaaaaagggcctgaagcgctggctggcggaggataactttaccgccgacggtcagcagcgcgaaaagctggaggcgctgcgcgacagaccctgacagggtgataacgggatcacattaaaatatctttcaggaccgccgccagcagggtggtggtcatgagaatagataaccgtttgatccagcgcatatcggtggtcagggtaacaacgtcatttctgaggctgtccacagccgaagttaatcggaaattcatttcactgagagcgacatccagcttatccaccttggcttctaactgattaaaacggatggccagtttgtccgtttttctttcaacatggccaagccgctcgtctatctgatgtacttttgttgtgagctgaccaagccgctcatctatctgatcgactttggttgtaagctggccgagccgaatgtctatctgatcaacttttattgtaagctggccgagccggttgtctatttgatcaacttttattgaaagctggctgacccggctgtctgtctggtcgactttcaatgtaagattgccgagtcgatcatccatcaggtcgactttggtcgtaaggtgactgacccgatcgtttgtctcgtcgaccctggtcgtaagatggctgaccagatcgtttgtttcgtcgattttagtcgtaaggtggctaacccgatcgtttgtttcgtcgactttggttgtaaggtggctaacccgatcgtttgtttcgtcgactttggtcgtaaggtgactgacccgatcatttgtttcgtcgacttttgttgtaaggtgtctgacccgatcgtttgtttcgtcgactttggtcctgagctgactgacccgatcgtctgtctggtcggcttttgcctgaagctggccgagccgaatgtctatatggttggctttggtctgaatctgaccgagttgctttccaatctgtccgcctggctgcctctgctgcatatcagtaaacacctccaccatcgcctccgcttgctgatcgtcgatccctgcctgttgcagcgctttaaaggctttgtgggtactcatcattgtgcttgtcatcacgacacctccctgtgcacttcagcgataacggcatcatgacaggcaaaagacgtatcgccactaagccggttatattttgcgcgcctcgccgaaaaatatcaattagtacaacaagtaacgtgcagcagtgtgcgggctgtctcgcaacatttagctgatggcaggatgaggcgactctgcggaaatccgcagagtcggaaagagaaaagcgggcgtcagggctgtggcacgattttaatttcaaccatgccgatgcccagtttgcgcggatcctgaccggtgatattgccggtgttactcagctgcggttcaggtggtgcaatcaccagacgatggctggcgcctgggttatcaaaatgcagggtatgtgtcgatatctcttcactcagtgacagcagttgctgctgatcgccgacccgcaccggaatcgcccggtgcgtgttggggccatacgcacgcgcggtgatcaccagatcgaacttcgcgggcagcgcatcgatatagtcgatatgaacctcgggcgcgagattagcgttagaccagcgtccccagctctctggccgtgagatgccgctgaagcttttaacactctccggcgcgccaggcacgtcgagccggaagctgtcagcgctgtagcgaatgttgttatcttcaatacggatctgcgcgaggttctgctggtaacgcgcatcgctgatagcgccctcggggaaacggactttgcctttccactgcggtttgtcgacatgcgtcaccgacggcgtgccgccgagctgtcccattgccacacagagatcgccggagagtgccagcgaaggctgccagagtcgcgccattttaaaacagcgatccacccagaggaatttatcggctgaggcgaaatccgccagctgatagcgcagcggtgccgaatattccccctccggcatcggctcaacgtgcttatcactgatgcggaacagaatcggcaatttgaaggtggtccccgagaagctgaagatattcttcgcctgatccaccgtgaagttgtctatcttcttcgggaagttccacagctggataatgtcgggcttccagctcgtcaccttactcttcatatcgtcgaactgggtggagagtgaaagcgatgagaggctgctgcggcccaggccaatcgcgttatcgccgccgagaatatcgagcagcgtggcgccgttatccagcgtgctgcgcttcgcctccatcaattccgcctgcggcttgtcaccacggatcaccatgaaaagattgcgacggggctgtttgaccagccacggatgcgcagtgttgttcatcgccagatgatccgagctcaccacaatcacggtgtttttgaaccacggcgacgctttaatgcgcgcaatcaggcgcgccacatgttcctgcgagcaggcgaccgcactgaatgactgattcggtttgccctcaatgctgtagctcctgcgatcgcagctgcgtgagataaatccgtcaggatgatgggtgtcgacggtcagcgtaaacagcgcaaaaggtttaccggcctgagagagttcctgatacttctcaaacacctcatccattaccgtatcatcgtaataaccccagttattacggtaggtgggatcggcgacgcggcttttcagctcctgcgaaccataaaggttagcgggatcaaaaccgtgtgatttcaggaagacatctttcccggcgaaacgcagatcggcaccctgaataaaccagttctcgtagccggagttcttcaggatgtcgcccagacagacgttctgtggatagaagctggagagcgatgctgacgcattgccatcaaatggggcaaacagcggaatgccacactgtgaggcgaccatgcccgcaatggtgtaatcggtacctggcagctgttcggtttcgctgaagtcgatgctctgctctttctgccggctcagctccggcgctaagccgggaaaggcgatagggtcaaaataggtgcgctctaagctttcaccatagatgtaaaccacgttgaggtgcggctgttcaatgcgattacgcggcactttatagaagttgtcgaagtcagaatctgccagttgggtatgcgacacaatcagggtcgcgacctggcgaaaggccggggtagtctgcaccgagccgagtgcgcaggcggcggccagcagcgaccagcccatgtgatgcggacgcttacgccgccgcagaatccacgacagcaggcagaacagcagaaacagcacgatgatcagcccaatcgccggcaccacatatttactgacgcccgcgccggtcaggctattggtcagggtatagagcaccgcatcgttgatgccgtcaccggtaaaatagttgctggcatagagggtggcgttcagcacaacgaaaagcaccagcagaataagaacgacaataaaccagaatttgttacgcccggctttacaggaatagattgcaatagcggccagaaacaacgcgacggacaccaattcggacaacggcaaatcctctcttcagggctacgcgaggcttcacgcaaccggccaccttcgggggatggtttttcgacaatctatattggctgtaatccggctgcaacatatccggcccgatttgtgcggtgaagagcagattggtttattgtcatttcagaagtgaggttatcaggcgtgacggtggctggcgcgcaccgtcagcagagcagaagtcagggcgattttcagagtttgccggtgagatattgtgcttcgccgtcggcaaaactccagtcacctttgtcgttggtgataaagctgatcattaaatcgttgccctgcacaccacaatgctcacgcagctcacgcgccagctcggccatgaacagctgtttctgttcactgctgcgtgggctggtatagacccgcaccatcaccagattatcgctccggctgaaccccagtccggtatcctgaaacaccatctgatagcgcttgttttcctgaacaatctggtagcgatcgcgttccggtaccttaaaggccgtgagcacggcgcggtgtgccgcatccagcagtttacgaagatctgattctgaacgaccctggataacatcaaattgcagcagtggcatagcggattcctcccggtgattaagaaccctatggtgacccctttatccggcgggaaaaagcgcgtagcctgaaatgattattcactatagtgaacaatcacgatgaaagagatgaaaacggatacgctgtgggatcatctgcactggctgaccgtactggcagagcagggcagttttacccgcgcggcagagcggctcgacgtcagcaaggcggcgatgagtcagaaaattaaagagctggaggagatggccggtgtgttgctggtacaacgcactacgcgcagcgtgcggctgacctctgccggtgagaagctggtggaggagctacgcgagccttttgcccgcattgaacagagttttttcagcgtgcgggacaccgccgggccggtccgtggcctggtgcgcattaccgcaccggtggcgtttgcccgtcagcaactggtgccgattatcggtgagtttctgcgtgattatccgcaggtgcgtctgcagctggatgtgactgaccgcattgtgtcgctgagcagcgagggatttgatctggccattcgacacagcgacaccctgccggaaacccacgtggcactgccgctgtgtgacacgcggacattactggtggcatcacccgcctatctcaacgaaacaggggataccgcagtcgccgcaggatctggcgcagcataactgcctttactatccacgaggcgtcgaatcaccgcgctggcggtttaccaccaccgcggataacgagcaggtccagatacggattcagggcagctttgccactaacaacagcgagtcgatacgcgatgcggccctgcagggattagggatcgctatgctgcccgatttcagcgcccgggaggcgctggcagcagggtcattgcagcaggtgctgcctgcgtggcagcctgttgaggcctttgccgcccgcctgtggatcgtacgaccctgggcggcgcaggtgccacgcgcggttaccacgtttacacactggctacgcgcgcgctttgaccgttgatggcaatgccagcgcaggtggcgtggtgtgcatcatctcgccaatcaggctgctgcggttatataaaccaagccgcagattgaagtcgagatgcagccgctcgttgccggttaattttataatgggtggcggcgtctgtggccgctgctgaaacatcactgactgcgcaaaggcgctgctgctgtcggcatgcaggcgctgatagaaccaggcgctggcttcacttttacgcagatagagattcgcccgccggtattcccgcatcgcaacctgctgcgccagcgacaggagctgacgagacggattctccatattctgcacaatcagcggaaaatcatcacgcttcttcagctcatggaaatagttgcggatgccgacgtttttaaccggcgccagctgtttcagccattcgcggataaacagattttgcggggcggcagcaagaaaccagctctcggtgatcggcgcaagcaggttcagcgttgattgctcgttatagtaaccaatgagatccattgatcgcgattcgtgaacgcgatgcacccaggcgagattctcaaacagcaatgtgctgcaatcaatgccgatgccgccataacggtgaatcagctcaagccggatgatttcacttttatgtgccagcgtcagatcggaagagataaagttgagatcgggcagccactgcgacagggtgcgctgcgtaatcagataaacctggtggtcggggttgtcccgccggattttactgatattcagcgccattgaggcaggcaggtgatcgttatgccagaccatccagacgatttttggaatctccggcagatctttctgctgcgcgatcaatacaacattatcctcctgacccggatcatattccggagcccgacagagtttctgctgttttctattccataacatctggctactgaacgatattcttttccagttacgccagattttatgcgctggacgttggcgatgtgaagtcatggtacacctgttatttttattttcccgtcatagtgcaggctctgcccgttccgccagcggcgggaacggccggaattacatactgactgcaatcccgatgagtgcgggaattaatgaatagttttccctggtggcgacgcagtgctggagcgcgcgatagtttcctcacggctgtttaattgcactgcacctttttaataaaacattatttacacattagctatgtctttttttgactttaggataatacggaaataatccggtcacgttatgaaaataataatgtcgtcactgttaatcatttatttaaatgcgggaataaacgcagttaaggaatatctgaatattattcttaacctgcgcgttatcctgcggcccgggccacaggaacagtggctattgtccttaactggtggtgtaagcccggctcatcaatccgcggaatcagacagcctgaagaggattgtctacgcttaagaagaacttactgagaaaggagcgcgcatgcagagtgaatcttacgggttactggcggttgataagcagggtaatcgcgtcctgtttcttaatccggaaaccttcgcggtcgagcgggaactgaacgcttttccaccgcggccgcatgaactcctgatgctggccccctggggtaaagcctatgtacccatttttggcgacggcgttcatggtaataacccgcatccgggtcacaaagtggcgattatcgatttacagcgtcgggagatcagtggctttatcgatctgtcgccgctgcgggcaccccacagcgggcagctgggccgcgatggcaaagtctatctctgctgtgagcagagtgccgcagtggcggtgatcgatccgcagagcgacaaagtggaaaaaatcattccaattccttctcacaacgcgcatcgcctgacgctgtcacccagcggccgcaagctgttcaccgataacgaagaggatgcgaccatcaccgtggtggatctctgtgaagcagaggggcgggtcatcgacaccatcctgctgcccgggccgattgcgggcatcgctgcctctccgaaacacccctatctggtcgccagcgccgctgatgcaccgttgctctatgtgattgatcggcaaagccaccgcattcgccagcgcctgacgctgccgggtcatgaacggccctgtcaggtggtacgcttcagcgccgatggcgagcaactggtggcgataggggatcaggaaccgctggtgacgctgtttgacgatctgctgaatccgctgggcgacatccgggtaggtaacatgccgatggatggctgttttacgcctgacaggcaacagctgctgattgccaatcaggatgatggcacgctgagcgtgatcgatctggcgcagcgtaaagtgattgccacgccgcgtgtcggaacgggctgtgaggtgctgggctattttccaatcggtcagataaacggacgatgatagatcgcggaactccagtggcggctgctggcgtgcttctccgcctgccagccgcgtttacgtaattcgcgcgcaatcatcttattcatgatgccgtggcccagcagcagcaccgtgccttgctgtgaatgctcgatcagcttctctgccgccgccgaggcgcggctgcgcgcatgttgcagcgactccgcttcacccgcatacccgcagaaccacaatagccgcaacagggccagccagcacagggtaggcaactgcaccgcgccggtttcgcagcagtggcacggcgacttcgctgaacacggcatcaacctcatggggctgcagaccgagctggctcagggaggattgtgcgcggggcaggggactacagacaatcaccgcggcctgacgtgcaatctcaatactgcgcggcggcggcccgtcactgacctgtgactgatcgtaggcttcgcaccagtctgccagcgcctgcacgctctggcgacctgccgcctgatgatcgggtttaccatgtcgcatcagaataatggtcataacacctctgcccggactttttgtcagagtaacgtattgtctgcgcttacagcgatatttcagaataaatacacgtgtcatctcatggtcacaggcgtgtgcgacaacagagcccgatgaaaggattttagtcagtcttataacgcttaatcataagagaaaatggtaacttatagtcgatggtgatttttttcaggcgatgtgttgcgggtaactggctgaatttgcgctaaaaatgcgtgacgacgggatgtgatagtgaagttttactaataattttcatcaggatctattgatttatctacgcgcgtagatacactaggtccccagtgattgctcacggtgcccgatgcacagtaggcccatcgattgttaagttacattcgctcagtttaagcgaccggtgaaaaatacaccggcgaaatggggcgaagaacaagattccaacaccagggaatcctttaacctttcatcatggttagtcaactgaacgtcgtcaccggggaatttccgcttttatcagggaatcgacccatggacgggcgtttatcgatctgcatactcattcagggatagggttatgacggcacacaactccgttaatcagcaggcatcactgtcatccacttcagccgccgatgagcggtttaacaccccttcaggccgcaaagatttctggcgcgccactttctcatgctggctcggaacggcaatggagtacgcggatttcgcgctctatggcctggcggccggtatcatcttcggcgacgtcttctttccggaatcaacccctgccatggcactgctctccagctttgctacctggtcagtcggctttgttgcccggcctatcggcgcactctttttcggctggctcggcgaccgcaaaggccgaaaggtggtgatgatctccaccattattctgatgggcgcttccacgacgttgatcggcttaatcccgagctatgcctctattggcgtctgggctcctgcctgtctggttctgctgcgctttacgcagggtttcggcgctggcgcggagttatcgggcggcacggtgatgctgggcgaatatgcgccgacagagcgtcgcggactgatctcctccgtgatcgcgctgggttctaacagcggcacactgctggcttcgctggtctggttgctggtggtacaaatggaccagcagagcctgctggagtggggctggcgtattccgtttcctcagcagtgcgctgattgcgctggttgccttgtggattcgacgtcatctgcgcgaaacaccggtgtttgagcgcagaaaagcggaaatggaagcggaacgcgcaggcgtactggccgctccggtggtggatcagcggcctttcttccagcgtacccgtgccttctggaccatggttggcctgcgtatcggcgaaaatggcccctcctatctggcgcagggcttcatcgtcggttacgtcgcgaaggtgctgatggtcgacaagtccgtaccaaccactgcggtgttcctcgcgtcgttgctgggtttcctgatcattcctttagcgggctggctctctgaccgctttggtcgccgggtggtttatcgcgtgttctgtctgttactgatgttctacgcctggcccgcctttacgctgctcgacacgcgtgaaccgatgctggtgatcccggttatcgtggtcggtatggcgctggcgtcgctgggtatttttggtgtgcaggcggcatggggcgtggagatgttcggcgttcatcatcgctacaccaaaatggcagtagctaaagaactgggctcgattttgtccggcggaaccgcaccgcttattgccgctgctatgctttcttataccggtcactggtggccgattgcggtttatttctcggcgatggccgcaattgggttctttaccacctttgtcgcgcctgaaacgcgagggcgggatctcaatctgcctgaagatgccatctagctttgcctgaggatgccatctgccaggatagcgcgaaaagcagcaggccgtgtaaagcggcctgtttttttatggaggaacgtgatgtgcctaagtcgttaacgggaaaagtgacccgaagtgaagttgcgaaagcggcaggcacctcagtggcagttgtcagttatgtcatcaataacgggcctcgtccggtcgccgaggcgacccgtcagcgggtactggaggcgattaaagcgaccggttaccggccaaatgcggcagcacgcgcactggcatccggcaacaccaaaaccttcggactggtggtgcccaacatcggcaatccttttgtggcctcaatggcgcacgtgttgttgcaggagtcgatgaatcacggccacgtcatgctgctgggtgatgcaggtgatgaccgcaagcgcgaaactggagttaattcagggactgcttaatcggcaggtcgatggacttttttacaacagcgttgatcgccatccttacattgacctgattaaagccagcggtacgccactggtgatgctggaacgggttgagcctcagccgggcgttaacatgctgcgggtcaatgagcgtcaggccgcctggcaggtgacggcacatctgttgagtcacggttatcagcaggtcggcataatcagcggcccggtcgatatgcttaacgcgcaggatcgtattcagggctggcgtgatgccatgcaggatcgcggtctgccgattgatgaatcgctgatgtttcccgccagctacaccccacagggcggatacgctgcggcacaaaccatgatcgcccggggtcgtgtgcctcgtgcactgtttaccagcaacgaaggtcaggcgattggcgcgcttcgcgccttttccgaacatcagattcgtgtgccgcaggatgtggcgctggtctgttttaacggtaccaatcactcgtcgtttcacgtcccgacattaacgaccgtgcgccagccactgcgtgagatggctcgctctgcgattcatatgctgaaagagggacagagcgaagcgcaattaaaggagtttccacactaccttgaaatcggtgaatcctgcggctgtgagccgcaaagccagagttagcctataaaaatatgaaaagaattattattgactgcgatcccggcaacggtatcgcgggtgccaacaccgatgatgggctggcgattgcgctggccttagcttcacctgcactgtcgctggaattgatcaccaccgtggccggtaacacgccatgtgaagttggcgcgcgcgtcgccaaagatctgatcgtccggctgggattatctatcccggtaatccagggggcgacgcaggcgctacaggaagatcctgcgccgtggcgcgagacgctggataaccgggtcaatcagcttgcgctgggtgagatgtggcagggcgtgcgccagccagcggatgtcgcggcggatgcgattgatgccgctgacgctatcggcaaactgatttgcgacaatccgggcgagattaccctggtggcgattggcccgctgacgaatgtggcgctggcaatgcagcgctatcccgccatggccgattctgtggcggaaattgtcatcatgggcggtgtgtttacgctggatgattatatcaaagacaccaattttggactggatccggaagcggcccatcaggtgttgcacagtggtgcagcagtaacgctggttccgatggatgtcaccacgcagacgctgctgacccagcaggatttgacccgcctgaccgccgtcgatcatccactgaccgaatttgtgcgcgatacgctgcgtccctggatcgactattcgatggcgacccggcagctggcgggatgctggatccacgatgcgctggtggtcgcctggttgctgaatcagcgggttgcgtcaggcatcgattaccgggtggatatcgaactgcgtcccggtgcgacgcgcggcaaaagctggcgttatcgtcagccccttcggctcactgtcggcgtgcctgagcagtgcggcgcatcggtgcatgtgctgcatcgtgtcgacaacacgctgctgttatcgattattgaacaggcatttaagcgcctgaaatcctgatgtcgtgggcgattaactcgcccgcttactggcggcggcggatcggtttcctgaagatcgctgtggccatcaaacgctgacggtatctgtcagtttgtcagccgcatcaggacgcgggcagaaggtgcagggcttgtgtgagctgatatccggcattacattgcttcgcacacgtcgatccagcgggcgttagtcagttcagccatcagctgtggggtaatgcggacggcgctgtggatagcgccggcggcgggcaggacttcctcgaaactgcgcagtgagacatcacagtaaacggtcagcgggttctcaaggccgaaaggacagacgccgcccaccggatggccggtccagttaatcacctcgtccacgctcagcattcgcgctttcgcccccagcgccgctttcagcttgcgattatccagccgggcatcgcctcgtgtcacaatcagcaccacgtcgtttttcactttcagtgacagggttttggcaatctctcctggcgtcacgccatgggcgcgggcagccatcccgaccgtcgcagtgctttcggccagttcaataatttcaatttcaggggcgtgttcggcgaagaaactggcgcacggactccaggctcatctttctctccaggctgatcgaaggcgtaaaaattgccacaagcctcagtgcctgtaaacgagataaacggagaattcagcgtaattaagtctgtttagctgccgctcagggtgcagttgccgcattgttcgacatcgggaatgcgataacgctggcagcagctgcgacggaccagttcgccgttgcgcgggatcatggtgcggtagagcgggttttcgctgccatccagcagccgctggttgaagaacagcgcctgctccagttgcagcaccagcgactcatcgatctggcttttcagttcacccaggaaccactggaatgagtagcccatattgttccagatgagtcgggcgttgatatcaccatgctgcgtaataccattgaccaccgggatcagatgctgctgaatcagccgatcgatacgctgctgagggttaaggtagcgcgcttcttcatcctcctgcacatcgatccagaaagtggccggatgaccattttcatgaaaaccgacgcggatatgctctggcgagcagtccagcgcacgcgactcctgcaacagcgccatgatcagtgttggcagcagcaggccaaaataccattgcgcccagagtgacagcaccggtttcgcttcacgaaccgcatcaggatgatcgcgatagaggtaatcgctgtagcgctgaataattggggtaaaggcttctgattgtgaccaggcggcgagggtcagcgtgtcgcgcggagcaggctggctgagcttcgtcgattcaagcagatagctgcgctgttgtttcagccgctcatgcagactttccgccagtggacggtcattctgccggaagatcatcgactgagcgttaaaacgctgttcctgagctgaaacggttgccatgacgactcgcgaaaagtgtagataagaaagcaaatgataatcgttattgattaactctacaagtcgtgtaaaaaatcgtcgttgcgggtgggaaaacggcggggttgaggtcagttatccgatcgggcagagcagcagagagccgggcatatcgcgccgaagcttcagtgattaccgatggcgttacgtttaattaggcatgttcactggcggcgtgatgctgttttcggggtaaatcttcccaggcgagaatggtattccggccctgatttttagccacatataatgcgctgtcagcattggcgaccgccaggtcaaattcattatcataaataggcgcgatgccggcactgatggtgacgtgggttgaaacggtttcattgaaaagatgaggaatttctaaatccagcacgtactgacggattcgctctgccagtttcatggcgatggaaactgttcacattggtcatcaataccagaaactcttcgccgccatagcgggtgacaacatcgcgtgaacgcaccgcatcacgaattgcgacagagacccgcgccagagcctgatcgcccatcgcatgcccgtaattgtcgttataggacttaaagtgatcgatatccagcagcagcacatagtggctgccagtatggttttccagaatattatccagccggttcttaagaccacgacggttataaagcccggtcagtgggtcgagcatgctgaggtcgctgaatgtctctttctcttcgtagagctgatgcatcaggcgcagagtaaagttgtcggcacggcggcgcatcagatgctgtagtgagaaaccaatcagcggcagcgtaatggttagcaggatcagcggcaggtgctgtgcattgtcgagcagcaatacggtgagcaccggtggcgtgacatgcagacaaaaagcccccagataatcgctcagggcgatggcactgataaataacacactgatcaaactgataataagaaagccaccatcaaaatagaacacctgatgaaagcgataattaatatgccaggcccagagcattcccagcagcagcgccacaggatttaacaggggaagttttactttaggccatattaaaagggaaattaacataatgccgctaaaggccgcgacactcattaccggcagggtcgtctcacttttctcactgctcattattggcagcagatgaaatagcgaaacggcgatattcagaaacaggaaaagcatcactgaaagccggtatttactctgcttcagctcttcataggattgtaatttcattataagtactcgtgacgaccctgaaataccaaagcgcacgccggcaaaaccaggttctgccagacaatgagcaaattattgctgttgctgttattaaaggtgttatcggccgcaatctagcattttccaactggtctgtcatcttcgttgccgggcgtgacaaaaacaggctgcagagcaggcaaaactgtcatatgataatgggaatgcttatcatttgaggttggtgtcatggggatagcgattatcgcggcctgcggcttgtggggagtcagttgggcactgggtaaaaagctggatagtgcgtggggcgtgttgctgccgtgcattgcgctgccgctgttcgccttatgggaaaccgagcttcagccagtggcggatggtgatgacggttgcgctgctgctgacagttgtgatgctgtttaaccagcggctgcgtcactatctgctgctgccatcctgtctggcgttagcgggcggactggcggctgtctctgtgaattttcatctgaattaacataagcggaatggttaaaaccggcgaacggggtaaagcggctggaaaaggtaaagcgaccggaaaacagaacaactggaaaaggtaaaacgagcagggggtaaaacgaaactacaggggaacagaagagatgagcgggaaaggcctgaagatgacaacgttggtgcgaagagagggacttgaaccctcacgtccgttaagacactaacacctgaagctagcgcgtctaccaattccgccaccttcgcatcgagttgtctgttcatatcaccgcaatggtgcgaagagagggacttgaaccctcacgtccgttaagacactaacacctgaagctagcgcgtctaccaattccgccaccttcgcgcagtgctcgcgatatgaaacttgtgattttggtgcgaagagagggacttgaaccctcacgtccgttaggacactaacacctgaagctagcgcgtctaccaattccgccaccttcgcatacccgtaacaccttgagaatgttacaaccacggaggcgcattctagagattttactctttgcgtcaacaactatttcgtcgggctgaaacgatcgctgtaaaaaacaacgttttcagcccggcaaagcagttaacggcaggaaaaacccttagcgcgttttggcaccgcgaccatagacggcacggtaaactttaaagcgcccggtttgcgcgatgacttcgtgactgccgaaggcttcatccagcgcctgcggatagggcaggaaggtgttggcaacgatacgcaactcgccgccggtattcaggtgcttcaccgcaccacgaatcagcgcctgtgcggcgtcgaggctggtctgagtgccttcatggaagggcggattagagataatcatgtcgaaacgaccggttacgtcagagaagacgttgctggcgaagacttcgccctcgatgccattggcggccagcgtcgctttactcgcttcaatcgccgctgcatgcacgtcacacagccacagacgcactttaggcgaacgggcaggcagcgaggcggcaatcacgcccgcgccacagcccatatccagcactttacctttggtgtgtggggtaaaggtcgacagcagcagggcactgccactatccagaccgtcacggctgaagacgccaggcagggtatgaatcgtcagaccatcaagctgatactggtgaccaaaggtgctggcatcgaattcaggctgtttgtcgaggcgaccgtggtagagaccacagcgacgcgcgctgtcgatcttctccagcttcacccatgactccatcatgccttcggcgcttcgcacgccgctgcggttttcaccgaccacgaacacgtcgcagcccaccggcagcagcgacagcaggttctgcagctggaactgcacttccggcttattcttggtccagaagtagaccagggtatcgcagccctgcacatcttcggcctgagcaaccattccgtaacgcgcctgctcgcccatacggcggctcaggttttgccagtgatgatattgctgggtgtgaacgcgcgatgaggcggtttccagctgagcgggcaggtcatcctgcagatcgccagcaaataaaacatggcgggcggtaaattcatcactgtggcgcagaatgacttcgctggccggggtaaaagcagacatgtagggctcctgtaagatctgagcggggattatagtggtttgttggcgcatgttcgatgggtttgctagcatagcgtcgcattcaggcagcagaacaggtaacaccatgacgtccaggcgcgactggcttttacagcaaatgggaattacgcagtaccaactgcgccgcccgcgcgtgcttcagggcgaaattgccgtcacgctggcaccggacacgcagttaattattgtcgctgactcaccacccggcctgcatgaaccgctgatgcgcgatgtgctgcatgccctcaatctgcaacccgctcaggtaatgaccgtgacaccggatcagctgcaaatgctgccggaaacgctgaactgcgcgggctggctgctcggcgtagagagcgaacagactttcaatggcgtggcattaaccagcgcctctttcaatgaactgatcagcagcggcgtcgccaaacgcgcgctctggcaacagatgtgtaaccatgacagccatctctttactcacccctgacgatctggcgcaggccttcgccattgaatgtcgtagtcacgcgtttccctggagtgaaaagacgtttgccagcaatcagggcgagcgctttatcaatttacgtctcgacgttgacggccaaatggccgcctttgcgattacgcaggtggtactggacgaagcctcgctgtttaacatcgcggtcgatcccgcttttcagcgccggggattgggccgccagttgttgcagcatctgatcgatgagttgatcaaacgcgacgtgctgacgctgtggctggaagtgcgggcctcgaacctgcccgccatcgcgctctatgagcagcttggattcaatcaggtcagtcgtcgccccaactattatcccaccgccagcggccgtgaagatgccattctcatggcactgacgccgtagcggtgttaaggagctttaatgattgataactgggattgcatcctgtttgatgccgacgataccctttttcatttcgacgcctatgccggtttgcagcgcctgtttcgccggttatgacgtgcagttcaccgaccaggattacagcgattatcaggcgataaacaagccgctgtgggtcgattatcagaacggtgctatctccgcgttacagctgcagactcagcgtttcaaccactggagcgaaaagctcagcgttgcgccggagatcctcaacagcggcttcctcagcgcaatgggagagatctgcacgccgctgccgggcgcggtcagcctgatgaaccaactgcatggccgggtgaaaatgggcatcatcaccaacggttttactgcgctgcagcagacgcgtctggagcgcaccggttttcgtgattacttctcggcgctggtaatctccgagcaggtcggccagccaaaaccggcgccagagatttttgattacgcactgaatctgatgggcaacccggatcgtgagcgggtgctgatggtgggtgatacgccaaagtcagacattctgggcggcatgaatgccggtattaaaacctgctggctcgatcatggcacccggccattgccggaacatattaagcccacctggcaggtcaaatcactgggcgagctggaagcgctgctcatcggctaacgcaagacgcctcgcaaatcagcatctttcccataaaaaatgcccgcacagcggtaatgtcagtcagttaagcgacaggtgataacgcagtctggtgccgggcaggggctggcggtcctcgcgccgctacgcggttccttcacttcattcctctgcctgacggaccgccggggatggcacatcctgtgccgccccgcctttcgcccgcgtcctgcgggctctcctggcagactcattctgttcagcgctgcggattgcctgctcctgcccggcaccagcctgctctgaaacttcagtgtgtattgttaaaaagggcacgagaatggaggcctgagcgcctctgctgctgaaagggctatccacagcgctgaggcgtgacggtgggccagaagtccacgccgggaagcgtggacagttcggggccggccagggagggccgatccccgaacggttcgtcggcacgacgtcaaagccgaaggtaccgcgtgagcggcgcgaggacggcccggcagcagcagaggtgctcaggcccgcactgcggcccgcccgcaaaaaaatctgccacgtttgaccgtgacagcctttacaaatctaatcttaactgaccagcattaccgttgtgcgggccttttttgttttatctttaccgcagccggagcgttactctttcttctcgtcgtcctcatcccgatcctctttcaccggggtgctggcggtgagcaggaacggcgactgctgccagcgggtgcggcggtggcgcagcagggtgcgtgagagaataatgccaattgccagcgccagcagcatcatcagacgcagaatattggtggtgttatcgacctgatgtgagtcggtgacgagcacgtgggtatccagcgtcacgcgcaaaaagcccaacggaccctcgtttccggccagcggctgcacaatctgatggttgaaatagctgcccgcgcgctggccgtcgagcgccagccgatcgcggacattgatgttttcaccgctgtgcgccaccaggctgccgtcgccgtcatagaccgatgcatccagaatacggctgttagccgtcatctgattaagaatggcttctatctgagtccgattattttcactgttgtccatcaacggcttaaggctgaacgccacctggctggtcagcgtatgcgccagctcctcgacctgttctgaacgtgccgcctgatggccgagactgaaccaggatgcgccctgcatcagcacgaccagcagcgccatcgagatgagaacgatcacggtacgatgtaagcgaaatttcagtgcggttttagccattaatcatccgggtcatatcacaacagaaagcctggagattatgttgccagaagcggcgcagacaaggtagcctcttgcgtggttttgttgtccctacaggagctctgatgccaaatcgtttaacctggtgcgatcttcccgccgatgtctccctctggccgggtttgcccctttctcttagcggtgatgaagtgatgccgctggattatcgcgctggccgtaccggctggctgctgtatggtcgcgggctggataagcagcggctgaccgattaccagcatcagctgggtgccgccatggtgatcgtcagcgcctggaacgtcgatgagtatcaggtgattcgcctggcgggatcgctgacgccgtttgccagcaagctggcgcacgacgctggcctggatgttgcgccgctgggcaaaatcccgcatctcaaaacgccaggcctgctggtgatggatatggactccaccgcgattcagatcgagtgcatcgatgagattgcaaaactggcgggctgcggcgagcaggtggcggaagtcacggaacgtgcgatgcgcggcgaactcgacttcaccgccagcctgcgtcagcgcgtggccacactgcagggggcagacgccaatattctgaaacaggtgcgtgatgccctgccgctgatgccaggcttaaccaccctgacgcagaagctgcaggcgctgggctggcaggttgccatcgcgtctggcggctttacctactacgccgaatacctgcgcgacaagctgcatctgtcggcggtggtggctaatgaactcgaaattcgcgacggcaaactgaccggcaacgtgctgggaccgattgtcgacgcacaatacaaagccgataccctgaagaagctggcgcagcgttttgacatcgcgccggaacagacggtggcgatcggcgatggtgccaatgacctgctgatgatcaaagcctcagcactgggcattgcgttccatgctaaacctaaggtgaatgagcagactgcggtcaccattcgccatgccgatttaatgggggtgttctgcatcctcaccggcagcctgatccacgaagagcgttaactgaggtattgatttggccaaagcggcaaaacgcgcatttgtctgtaacgaatgtggcgcagattacccacgctggcaggggcagtgcagcgcctgtcacgcctggaacaccatcaccgaggtgcgcattgccgcctcgcccgcggctgcgcgtaacgagcgcctgagtggctatgctggcagcgccggcaccagccgggtgcagaagctctctgaaatcagcctggaggcgttaccgcgcttctcgaccagcttcaaagagtttgaccgggtgctgggcggcggggtggtgccgggcagcgccattctgattggcggcagccccggagcaggcaaatccacgctgctgctgcaggtgatgtgccggttgtcagaggggatgaaaaccctgtatgtcaccggtgaagagtcactgcagcaggtggcgatgcgcgcccatcgtctgggattacccaccgaaaatgtgaatatgctgtcggaaaccagcattgagcagatctgcctgattgccgaacaggagcagccgcaactgatggtgatcgactcgatccaggtaatgcacatggcggaaatccagtcatcgcccggcagcgtcgcccaggtgcgtgaaaccgccgcttacctgacgcgcttcgccaagacgcgcggcgtggcgatcatcatggtcggtcacgtcaccaaagatggctccctggccggaccgaaagtgctggagcactgtatcgactgttcggtgctgctggatggcgatgccgattcccgcttccgcaccctgcgcagtcataaaaaccgcttcggcgcggtcaatgaactgggtgtgtttgccatgaccgagcagggcatgcgtgaagtcagcaacccgtcagctattttcctgtcgcgcggcgaagagatcacctcgggcagttcggtgatggtgctgtgggagggaaacgcgaccgctgctggtggagattcaggcgctggtcgatcactccatgatgggcaatccacgccgcgtggcagtgggtctggagcagaaccgcctggcgattctgctggcagtattgcaccgtcacggcggattgcagatggcggatcaggatgtgttcgttaacgtggtcggcggcgtcaaagtcaccgaaaccagtgcagacctggcgctgatgctgtcgatggtgtcgagcctgcgcgatcgtccgttgccgcaggatctggtgatcttcggcgaagtgggactggcgggcgaaatccgtccggtgcccagcggtcaggagcgcatcgctgaagcggcgaagcatggcttcaaacgcgccattgtgccggcagggaatgcaccgaaaaaaccgattgccgggatgcaggttttcagcgcgaagaagctggccgatgcgctggcgattctggacgatctgtaacgcgcctgcggccgccagcgaaaagccgctggcaggccgctcccaccttaaccgcattgatgcaggaggcacgacatgtcgtcgtttgattatctgaaaacggccattcgccagcagggccacacgctgcaacaggtcgctgatgccagcggcatgaccaaaggctatctgagccagttgctcaatgccaaaatcaaaagccccagcgcgcaaaagctggaggcgctgcaccgttttctgggtctggagtttccgcgccgcgataaaacggtcggcgtggtgtttggtaagttctatccgctgcacaccggccatatctatctgattcagcgcgcctgtagccaggtcgatgagctgcatatcattatgggctacgacgagccacgtgaccgcgagctgtttgagaacagcgcgatgtcacaacagcccacggtcagcgatcgactgcgctggctgctgcagacctttaagtatcagaaaaatatccgcattcacgcctttgatgaggaggggattgagccctatccacacggctgggatgtctggagtaagggcgtcagcgcgtttctcagcgagcacggtattgcgccggactgcatctacaccagcgaagcgcccgatgcggagatgtatcagcagcatctgggcattcagaccgtactggtcgatcccagccgatcctttatgagcatcagcggcgcgcagatccgtcaggatccgttccgcttctgggattatatcccgaccgaagtgaaacctttctttgtgcgcaccgtggccatcctcggcggggagtcgagcggtaaatcgacgctggtgaataaactcgccaacattttcaataccaccagtgcctgggaatatggccgcgactatgtcttctcccacctgggcggtgatgaaatggcgctgcaatattcagattacgacaagatcgcgctgggccaggcgcagtacatcgatttcgcggttaaatacgccaataaagtggcctttatcgacaccgactttgtcaccacgcaggcgttttgtctgaagtatgaggggcgtgaacatccgtttgtgcaggcactgatcgatgaatatcgctttgatctggtgattctgctggagaacaacgtgccgtgggttgccgatggcttgcgcagcctgggcagttccgtggatcgccgggaatttcagtcgatgctggtgacgatgctgcgggaaaacaacatcgaattcctgcacgtgcaggaagatgattatgacacccggtttcctgcgctgcattgaactggtgaaagcgatgctgggcgagaaaaacgcccagccgtaacgcatgctgtaacccggtctgccgcagggcagccgggtcagtgcattaatacaccatcactactttgccgcgcatgtggccttccagtacgcgctgatgggcggcggttaaggtctcaacgcttaagccgtgcagcgtctcgctcagtgtggtttgcagcttaccttcatccagcaacgccgaaaccgcatccagaatctcaccctgacgtgccatatccggcgtgttaaacatgctgcgggtgtacatcagctcgaaatgcagggcagcactcttcagcttcagctgatccatcgacagcggatgttcgttttccacgatggtgcagatatgaccctgcggggcgataagctttgccatggtttcccagtgaccgtcggtatcattcaggcagaagatataatcgacctgtttaatgccctgtttttccagctctccaatcatatctttgtagttgatcaccagatcggcgccacgatcgcggcaccactgcgcggaatcttcacgcgaagcggtggcaatgatcttcaccttgctgcgcagtttcgccagcgggatcgccagcgatccgacgccgcctgcgccgccgacgatcagcagcgtctgatcttccgttgctgactccaggttcagtcgctcaaacagtccttcccaggcggtcagggccgtcagcgggatcgcagcggactgcgcccagtccaggctctctggcttgtgaccggtaatgcgtgagtcaaccagctgctcggtgctgttactgccaggacgggtcaggtcacccgcataaaaaactttatcgcctggcttaaagttgctgactttgctgcccacttccagcaccacaccgctggcatcccagccgaggatgcgtggctgctctagtccgttcttcttcgcccctttgtgaaccttggtatcgaccgggtttactgacgcggctttgacttcgacccgcaggtcatactcccctggcgctggggtatcagggaaaatttcagtaaagttttcaggactttccggattaattgcgatagcgcgaatagacatacatttttcctgtttagtcaggctaaaagcctggatctggtggttgccattctggccctgaaaagtgctcacactccgcaggggttgtgccacgctgtccgtggcagactggctgatgattcggaacaggctttaagtgtagaacctgattttagcagtgataagatggacaatctttcatagagtgttcgtctgaggtgaacaatggcatttcgtcagtggcaggatatggcactgtttgcgctggtggcggagtgcggcagctttaccggcgcggcagaaacgcgcagggctgccaaaatcgagcgtcagtcagcgcatcagccagctggagcagcggctggggattcgtctgctgaaccgcaccacccgccagctcaatctgacctttgccggtgagcgctatatgctgcattgccaggagatgatgcaggccagtgaacgcgccgatcaggcgatcgccagcctgcgtgaaaatcccagcgggcgtctgcgcatcaccagcccggcggggattggtgccacgctgctggcgcgctgtaacgcggcgtttttacgtctctatcccgatgtgacgctggatgtctcgatctccgatgagatgcgtgatctggtgcaggagggttttgatgtggcgctgcgcaccggtcagccgcaggagtcctcgctgattggccgccggataggcaactgcccgcgactgctggttgcatcacagcgctatcttgatcagcatccgccgctggttcatccacagcagctgtcggcccaccgctgtattgcgcatcgtgcctggaatgaatgggtgttgcagcgcgatgacgagttctaccgctggctgctgccgccaggccatctcacggataatttactctatgcgcgcgaatctgcgctgggcgatgcgggcattacgctgctgccgcactttctgaccgacggggcgatggcggatccccggctggtgccggtactgccggaatgggaaatcgaggggaatgagctctggctggtctatccgggccgtaaactgaattcacctgcgctggcgcggtttattgagttcgcgctgcagtcaccggtgttcagggagttttatcgctgaccggtacaatgtggcgcaggaagagtgccgccattttttccgggccactctggtaacccgcgatatttgccgctaaccagtcgctggggctcacgccttcccagctcacctgatagcctgcgtgaagaatgatatgctcgaacagaatgcgtaatgcccgaccgtttccttcccgaaaggggtgcaggatattgaactcgcagtaataccaggcaacctgatgacaaaaagcttcatggtcagtctgctccagccatctttcgcacgccagttttgcaaataatttctccgcttcacgcagaataaaagcgggctggcaaaagcgggtctctcctttgctgatagagatatcgcgtatctgccccgcccaactataaagctcgttaaacaggcagtaatgaatgtgacacagtgactgaagggtaaaaggaggatgagagagcttaatggtgtgaatggtcagtgcggtaacatcacgctcagcctgatccagcagggtttgttcgcggatatcatagcgattgatcagcacatcggaatcgggataacagtagtgatctcgccagacaagataacgattcacgttggcttcctgctactgcttatagcggcgtcgaacctgttccagggtcgataattcagcatctgctgaaatacgtatcccctccagcagggaacttgcggcaaagtttgcgactttagtggcttcataaatcgcttcagcttttttagccactggccgctcagcttttttcttcattgcgttcagcccttaaaacgtcactggtgaagcaggaggaggcctgagcctccccctgacatcgttacttcgtcatacgcttgtacttgatgcgcttcggctccagcgattcggcgccgagggtacgcttcttgtactcttcatattcggtaaagttaccttcgaagaattcgatgttgccctcatcctgataatccaggatgtgcgtggcgatacggtccaggaaccaacggtcatgcgagatcaccatggcacaacccgggaactccagtagggcgttttccagcgcgcgcagggtttcaatgtccaggtcgttggttggctcatcgagcagcagcatgttaccgccaacctgcagcagcttcgcgaggtgcagacgaccacgctcaccacccgacagtttcgcctacgcgtttgccctgatcgacgcctttaaagttaaagcggccgacataggcgcggcttggcatctcggtgttaccgatgcgcatgatgtcctgaccgccggaaacctcttcccacacggttttggcgttatccatgctgtcgcggaactgatccacagaggccagtttcacggtttcacccagtacaatctcgccggaatcaggttgttcctgaccagacatcatgcggaacagcgttgatttacccgcgccgttcggaccgataatcccgacaatcgcacctttcggtaccgagaacgagagatcgtcaatcagcacacggtcgccataagacttacgcagattgctgacttccagcactttgtcacccagacgggcacctggcggaatgaacagttcgttggtttcgttacgcttctggtagtcggtgttgttcagctcttcaaagcgtgccagacgggctttgcctttagactgctggccttttggccctttgcgcacccactccagctctttctcaatcgacttgcgacgagcggcttcagaggaggcttcctgcgccagacgcgcatctttctgctccagccaggaggagtagttaccttcccacggaatcccttcgccgcggtcaagttccagaatccagcctgcaacgttatccaggaagtaacggtcatgcgtaatcgcgacgacggtgccttcgaagtcgtgcaggaagcgctccagccaggcgacagattcggcgtccaggtggttcgtcggttcgtccagcagcagcatgtctggtttttccagcagcaggcggcagagggcgacgcgacgacgttcaccaccggaaagggtggcgattttcgcgtcccagtcaggcaggcgcagcgcatcggcagcacgttccagctgggtattcaggttgtgaccatcgtgagcctggatgatctcttccagacggccctgttcagcggccagtttgtcgaagtctgcaccttcttcagcatagagcgcatagacttcgtcgagacgcttcagtgcgccaacgacttctgacagcgcttcttctaccgactcacgcacggtgtgttcaaggttaagctgcggttcctgcggcaggtagccaatcttgaggcctggctgcggacgcgcttccccttcgatatctttatcgatgccggccatgatgcgcagcagggtagatttacccgcgccgttcaggccgagtacgccaatttttgcgccagggaagaagctgagcgagatgtttttcaggatatgtcgcttcggcggaaccactttgccgacgcgatgcatgctatagacgaattgagccacgttggtttgagcctctgggtctgttggtcgtttgaatgatgtcgaagtttagcctttttcaccgtttaatcccagccggggggcggcgaatattagcgtggcggagccgatgccaggcgatgccaggcataactgactgatttccacgctcaatcgctgacagggtcaggagaggatgtcagaaagaggcgtcagggcaggcgcagcgggatcgcctgctgggccagccagttttgcaacgcctgatcgggcgcgctgtcactcaccagcagatcaaagcgctgcagctcggcgatgcgggcaggcagcaccttgccatatttactgctgtcagccaccagcaccgactttcgggcgcgcagcatggcgtgatgcttcatcatcagctcattggtgttgtagcaggtcgcgccctgatctttgtcgatgcccgctgcagagataaaggccagcgtcgggcagagatcgtcaaggatggtatgcacgccaatcggcgtaaacagggcgttgtcggcatgaaattcaccgccgctgagaatcacgttacaggccggtttctctttcagcgtcagaaaggtattcatggcgcagcagatggcggtaaacgccagggtgtcgggaatcgcatccacgatgtagggcagggtggtgccgcagtcaaaaaagaccgtatcgttctcattgatcaggctggcggccgcctgtgccagtcgctgctttctggcggcattctggccatgctgatcgctgacaaaatagtggctggcatgacttttcggatcgctgacgatatagccgcccagcaggaccacgctggagcccggctcggttaaatcgcggcgaaccgtcatctctgagacgccaagcagctgggccgcatctttcagatgcagtttgtcggtgcgtttcagcgcctgcgtcagcttgtgaatgcgttcgtcgcgccgggtttccatggtcatctctctgttccctatcctgcagtgcggaggaaagacgccgggatcgacgtcaatacgctacaaacctcacagatttgaatgagttgcgtctcatccgccaggctggcagtcaatcttacccgcattccgtgagggccgcaaacctccgccgtgctgtcagcgcgtggtgatatcggcacatcaccgcgggcggctgtggctttcatccaccgcggttagtgatgttggcttgttataataataacactgaaaatcccctttcatggcgtcatctgcctgttctcaccgcctcaggatgtggtttttgtcacatatttaacctttaagaattgttattgttaatttaataacattttaagtttaaaaaaacatccgggagaaaaggtcatgacaattgcggtcatcggctcaaacatggtcgatctgattacctataccaacagcctgccgaaagcgggcgaaacccttgaagcgcccgactttgccattggctgcggcggtaaaggggccaaccaggcggtcgcggcggcaaaaatgggtggcaacgtaatgatggtcagcaaggtcggtgacgatctctttgctccgaacaccgttgcaaaccttcaacagcagggcgtggacacgcgcttcgtcaccaccgcaccgggcacctccagcggcgtggcaccgatttttgtcgatgaccagtcgcagaaccgcattctgattatcaaaggtgctaaccagcagctgaaaccggccgatatcgacgacgcggctgaggcgctgaaagcctgccagctgatcatcctgcagctggagatcccactggagacggtctattacgccatcgattttgcccgccagcatcagatcacagtgatccttaatccggctccggccgtcgccacgcttgatattgattacgcctgcaaatgcgacttctttatgcccaatgaaaccgagctggagatcctcaccggtctgccggtcagcagcgatgaagaggtgatcctcgccggacagtcgctgctgaagcgcggccttaaaaatctgatcatcaccctgggcagccggggatcggtctggatgagcggcgacgagatccatcgcgtggatgccacaccggttcaggcggtcgacaccagcggcgcgggcgatgcctttatcggctgctttgcgtatctgctggtggaaaccggcgatgtggccgccgccatgacccaggcgtctgcctatgccgcctgcagcgtcaccgggcgcggcacccagcgcgcctatcccgacgcagagagtttccagcgctttctcaaccgtaactgagggtctgccatgcaacagaaaattgttcagcaatctgatggctatctgaataaaacgccgctgttccagttcattctgctgtcgtgcctctttccgctctggggctgtgcggcgagtcttaacgatatcctgatcacccagtttaaaagcgtatttgccctgagcgactttgccagtgcactggtgcagagtgccttttatggcggctattttctgattgcgatccccgcgtcgctggtgatccgcaagaccagttataagatggcgatcatgatcggcctggcgctctacattgccggctgtatcgccttctatcccgcctcgcacatggcgacttacaccatgttcctggcggcgatatttgccatcgccatcggcctgagtttcctggaaaccgccgccaacacctacagctcgatgattggccatcgtgatcacgccacgctgcgcctcaacgtcagccagaccttctatccgatcggtgcgctgatggggatcgtgctgggcaaatatctggtgttccaggatggcgacagcctggagagtcagatggcgaccatgacggcagagcaggcgcatgcgttccgcctgacgatgctggaacacacgctggagccctacaaatatctggtgatggtgctggtggtggtgatgctgctgtttatgttcacccgctatccgcgctgtaaacccgaaagcagcgagatgtcgcgcccctcgctgggcgagactttccgctatctggctggcaaccgacactttaaacgcggaattgtgacccagttcctctatgtcggcatgcaggtggccgtctggtcgtttaccattcgtctggcgctgacgctgggggcgactaatgaacgtcacgcctcgaactttatgatctacagcttcatctgcttctttatcggcaagttcgtggcgaacttcctgatgacccgtttccgcgcagagaaggtgctgattgcctattcggtgctgggcgtgctgacgctggcttatgtgatgctggtgccgaactttaccgccgtctacgctgccgtctttgtcagcgtgctgtttggtccctgctgggcgacgatctacgcgggaaacgctggcgacggtcgataacaaatacaccgaagtcgcgggcgcgtttatcgtgatggcgattgtcggtgcggcctttgtcccggcgctgcagggcctggtttcggactcactgggttctatgcagctggcatttggcgtctcgctgctctgtttcgcctgggtcggattctacttctatggcgaactgcgccataaaaaacagccggttgcgaccggtcgtctggcggaggagttaccatgaaaacccgtttacccttagcgcgtgaacagtttcacaccacaccctgggtgcttttagaaagcgataatttccgggttgagctgtttcgctatccggcgggcattgaggcggtgcgcattcataaccggcgtggcagcgtgaccgtgctgccgtttctcgggcagatgatctgggacgcagagttcgacgatcataacctgaccatgggccacagttttaagcagccgctgcccgcaaattcgatcatcgacacctatggctgttttgcgtttcattcgggactgctggccaacggctgtcccgcaccagaggacgatcatccgctgcacggtgagatggcctgcgcccgcatggacagcgcctggctggtgctggaggatcagacgctgtcgctggaaggggagtgtgaatatgtcaaaggcttcggccatcactacctggccgcacccgccgtccgcattccggccgatcagccccggctgacgattgaaatgacagtcactaatctggctggcgcgccgatgccgctgcagtatatgtgtcacctcaacagtgcgtggatcgatcagggccgcttccggcagtcgatccccgaacaggcattccagctgcgtcgctcgatcccggcgcatctgcgaccgacgcccgcctggcgggattacaccgatcggctggcgcgcgatccgcaggctttacagcagctcgatcagccgcagctctgcgatccggagatcgtcttcttcgcggacgacctgtcgcagtatagcgatgaggtgcagtttgagttgcatgcgccgcagggctatgcgctgatgacgcgcttctccaccgcgcagttcccgcacgccactcgctggctgctgcacaaccacgatcagcaggtggcggcctatattctgcccgccacctgccggccagagggctctcttgccgcgcagcaggctggcacgctgatcaccctagcgcacggtgaacagcgccacttttctgtcgagaccggcttactctgagccgggtttaaatcgccaccaggccgcgcacaccctctgcttccatggtgtcaccgcggccacgctgcacaatttctccgcgcgacatcaccagatagctgtccgccagctccgccgcgaagtcataaaactgctccaccagcaggatcgccatatctccccgttgcgccagctggcggatcaccgcgccgatctctttgatcaccgaaggctggatcccttcggtcggctcatcaaggatcaacagctggggccgacaggccagcgcccggccaatcgccagctgctgctgctgaccgccagagaggtcgccgccccggcgtgacttcatcgccagcagcaccggaaagagctggtagatctcctccggcacttcacgcgcctgcgcagccggaaagcgtgacaggcccatcagaagattctcttccaccgtcagacgcggaaagatttcccgcccctggggcacccaggcgatgccagcctgcacccgctggtgcggcttgcggccattcatgcgctgctgctgccagtgaatctcgcccgacttcgccgggatcagccccatcaggcatttcagcagcgtggtcttccccacaccattgcgccccagcagacaggtgatttcgccaatctttacctcaaacgacaagccgcgcagaatatgactgccgccataatattgattcagttcagtaacctgtaacatttcagcgccccagataaacgtcgataacctgctcgttggcctgcacgtcgcgcagcgaaccctcggccagcacctgaccctgatgcagcaccgtcacgtggtcggcaatggtttcgacaaagcccatgtcatgctccaccaccatcagcgaatgcttgcccgccagtctgcggaacagctcggcggtgtagtccgtttcggcatcggtcatgcccgcggccggttcatccagcagcagcagatgcggctcctgcaccagcagcatgccgatctccagaaactgcttctggccatgcgacagcaggcccgcgcgacgctggcgtttcgccgcccagccgcagcagtttcagcacctcatcaatgcgatcacgctgttcaccgctgaggcgggcgcgcaggctggcccagaccgatttatcggctttaagcgcgatctccagattttcgaacacggttaacgcctcaaacaccgtgggcttctggaacttgcggccgatcccggcgcgggcgatctccaccggcgagagacgggtcagatcgctgtcctggtcgtagatcacccggccggcgtcgggccgggttttgccggtgatcacatccatcagcgtggttttgcccgcaccgttggggccgatcacgcagcgcagttccccgacgccgatctgcagcgaaagatcggtcagcgcccggaagccttcaaacgacacgctgatcttctccagttgcagcaccggatcgcgctgcacccgatggcgatccgccagttgagtttgggtaaacagggcatcactcattttttcctccggcgcagcaggccaatcacgccgtgcggcagaaacagcgtgaccaggataaacatcagccccaggaaaaagagccagtattcggggaaggcgacggtgaagaagctgcgtgcgccgttaacaatcgcggcacccagcagcgggcctatcagcgtaccgcgtccgcccagcgccacccagattgccgcttcaatcgagttggccggtgacatctcacccggattgataatgccgacctgcggcacatagagcgccccggccaggccgcacagcacggcggagagcgtccagacaaacagcttgaaaccacgcgggtcgtaaccacagaacatcagacggttctccgcatcccgcaccgcagtcagcacccggccaaatttgctgcgcgccagggcgaagccgatcgccaggctcagcagcagcagcagcaccgtggcgataaacagcccgatacgggtgggggttgccgtcaccgaaaagccgagcagggtggtaaagccggtaaagccattgttgccgccaaaaccggtttcgttgcggaagaacagcagcatcccggcgtaggtcagcgcctgggtcatgatggagaagtagacgcctttaatcttcgagcgaaaggcgaagaagccaaaaatcagcgccagcaggcccggcaccagcatgctcaggcagagcgcccaggcgaaatagtcggtgccggtccagaaccagggcagttcccgccaggagagaaaggacataaaggcgggtaaaccctcgcctgcggcctggcgcatcaggtacatgcccatggcatatccacccagggcgaaaaagatgccgtggcccagcgacagcagtccggcgtagccccacaccagatccagcgccaccgcgaccaccgcgtagcagaggattttgccgaccagcgtcagggtataggtggagatcgccagcggatgcgtggcgggcagcagcgccagaaacggcatcaccaggagcgctacggtaatcgccaggccaatgctgatggtcaggcgcggcgcggtgcgcgccacgcgaagcgtgatgggttgcgtcatcagtcagtcacccttccttttaccgcaaacagcccctgcggacgtttctgaataaacagcacgataatcaccagaatcaggatcttgcccagcacggcgccaatctgcggctccagcactttgttgagaatgcccaggctgaacgcggcaaccacggtgcccgccagctgaccgacgccacccagcaccaccaccaggaacgagtcgataatgtagccctggcccagctccggtccgacgttaccgagctgcgacagcgccacgccgcccagcccggcaatccccgagccaaggccaaacgccagcatatcgacgcggccggtcggcacgccgcagcaatccgccatggcgcggttctgggtcacggcgcgcacgttcatgccaaggcgggtccggttcagcagcagccaggtgagcgccagcacaaacaccacaaacaggatcaccgcgatgcggttccacggcagcaccagattgggcagcagctgtaagccgccggagagccacgccggattcgccacctccaggttttgcgccccgaacagcacccgcaccagctggatcagcatcaggctgatcccccaggtggcgagcagcgtctccagcggacggccatagagatggcggatcaccgtgcgttccagcgccatgccgatggcggcggtgaccagaaaggcgaccggcagcgccagcagcggataccaggctaaatagtgcggcgcaaactgctgaaacaggctctgtacccaccaggtggcgtaagcaccgagcatcagcatttcaccgtgcgccatgttgatcaccccgagcaggccataggtgatcgccagacccagcgcggccagcagcaggatggaacccagcgacaggccgctgaaggcctgccccagcagatcgccccacatcagccgtttctgaatctgttgcagactttccgccgcggcggcccgtaccgtggcgtccggctcattcgcgggctgggtcaggcgttgcaggctggcttgcgtattgggatcgctggactcacccagcagtttcaccgcccgcaggcgcaccatcggctcgccatccgccagttgcagattcgccagcgccagtgccagtgcggcatgaacccggctgtcctgctcggcggcaaaacgctgctccagcagcggcagctggtcggcaacgccctcactttgcagctgctgcgctgcacgcagacgcagggccgtatcagtgctgacaagctggtgggcggccagcgcgttgttaaccagcacgcgcaggcgattgttcataaacagctttttcaggttgcccgtgggctgcgccaccgcatccagcggctgcagcgtggatccctgctggctgaacggctgtttattctggtcgatgaccaccgtttcggcatgcagcgcttccagcagcggcaggcgatggctgtccggtgcggcggcccactgttgcagcagcgtggcctgctgactgcggctggcagcggcaaagtcagccgccggtccggcactggccaacagcggcatcagcagcagcaggctgaaaaagcagcgacatagattcataaaaggagcctcgtcaggggagggcagcacggcggggtgccgtgctgccgcttcacagcgggtgacgctgcgtatctatcagcaacgcgcgattactgcgcggtcttcaccgggtgatcgggttttttgtcgttaccggcaatgtacgggctccacggctgcgcgcgtaccggctgatcggtctgccacaccacgctgaactggccgttctcttccacttcgccaatcatgaccggcttatgcagatgatggttggtctgatccatggtcagggtaaagccatccggcgctttaaaggtctgaccggccatcgccgcccgcactttgtccacatccgtggtgcccgctttttccaccgcctgcgcccacatatgaatgccaacataggtcgcttccatcgggtcgttggtgacgacggtggcggcgtttcggcaggttatgtgctttggcatatgcgcggtagtcggcgacaaacttcgcgttggtcggattatcaatagactcgaaatagttccaggcggctaactgacccaccagcggtttggtatcgatgccgcgcagctcctcttcgcccaccgagaaggcgaccaccggaatgtcagtggctttgatcccctggttcgccagctctttgtagaacggcacgttggagtcgccgttgatcgtggaaaccactgccgttttgccgccagccgcaaactttttgatgttagagacaatggtctggtagtcgctgtaaccaaacggcgtgtagacctcttcgatatctttatccgccacgcctttgctgtgcaggaaggcgcgcaggatcttgttggtggtgcgcggatagacatagtcggtgccaagcaggaagaagcgtttcgcgctgccgccatcttcgctcatcagatactccacggccggaatcgcctgctggttaggcgcagcgccggtgtagaagacgttgggtgacatctcttccccttcatactgcaccggatagaacagcaggccgttcagctcttcaaacaccggcagcaccgatttgcgcgacaccgaggtccagcagccaaacaccaccgccgccttatcctgagtcagcagctgccgcgccttctcggcaaatagcggccagttagaggcgggatcgaccaccaccggctccagctttttccccagcacgccccctttggcgttgatctcatcgatggtcatcagcgccacatccttcagcggcgtttctgaaatcgccatggtgccggagagcgaatgcatgatccccactttgatggtgtcagccgcctgcgcactccaggcgcaccccatgctgacaacggtggcggagagggcgaaagccttgatcaacgaacgtcttttcatcatctgaaacccctgagtagttgttgtgttattcggtgagctggagccgggcctgctggaggcggtgcagcgtgatctttctgacctccgccttactcacggcgatgtgatcggtcaggatgcgttgcgccccggcggtctgctgctgaaaaatcgcctgtaaaatctgtgcatgttcctgataagtggcacagatgcgatcgtcgcgagtgaagtcgagccgacggataatgcggatcttctcggtgagttcggcgtgaatgcgtgccatctctgggttacccgctgccgccaccagcgtcatgtgaaatgcctcgtcatgctgcgataccaccaggccctctgtaagcggctctgcctcgcaccagaactggttcagttcgtttaacagcgcggcacactgcggcgcgggcagggcgcagaggcgttttaccgcctcgcactccagcacggtgcgcaggtcatacagcgattcgaaccaggcgaaatcgaagttcttaatctgccagccgctgcgaaaccagacttcgacaaagccttcgcgttccagccggaacagcgcctgacggaccggggtgcggctgaccgccatccgtccggcgatttcgctttcgctgaagcgatcgccgggcatcaggcgaaaggcgaagatatcggccttcagcgcctgataaacccgttccgccagcgcttccgggcgggctttaggggagtggggttgcgttgtcattaccgctccttattccagccacagcaggttatcgccaggactgaccggacggcccgcctggcaggcaatccgcgtcacacgaccggcctgcggggcgacaatcgccagctccatcttcatcgcctccacgataatcagcgtctgcccggcgctgacctcgtcgcccggctgcaccagcactttccagatgttgccattgagatccgcctgcaccgccagcccgtttctcctcctcttcgctgacgctggcgcgcgtttcatcctccggcggcgcgttctgctcctcctgcgcccatagctgcacttcctgttcaaaggcggcggcctggcgctggcggaacgctgcaatttcagcggcgtggtcggcgaggaactgctggtgggcggcaaaatcaaactgcgtctcttcaatacgcaggctggcgcggccttcgcggaaatcttcgcgcagctgggtcagttcggtttcactcaccggatagaagcgcacctgatcgaagaagcgcagcagccacggcgcatcggtagcgaactgcggatttttcaggaaggtgttccagatgggcagcgtgcggcccaccagctgatagccgccgggcgaatccatgccgtagatgcacatgtacatgccgccgatccctacggtgccttcggcggtgaaggtgcgcgccggactgtatttggaactcagcaggcgatggcgcggatcgatcggaacggcacagggcgcgccaaggtagacgtcgcccagccccagcacgagatagctggcgttgaacagggtatcgcgcacctcatcgcggctgcttaagccattaatccgctggataaagtccacgttgttgggcagccagggggcgctggcgcgcaccgtctcctgatagcggctgacggcacccagcgtggcgctgtcttcaaatgccatcggcatccacactacgcgggagggcactttcagcgtgctgacgtcgcccagcgtcgcttccagcgccagcagcagtgacatcagccgggactggttaatgatgcggctgtcgtagcgcacctgcagcgaacgcacgccaggcgacagctcctctacgccgggctccgcctgcgccgtcagcgcattcatcagcagatggacacgcagacgcagcgccagatccagcacattgtcgccatactcaatcagcacatatttgtcgcccgcctggcgatagaccactttcggcgtgctggtcgtggcctccagagcggccagaatcgtggcggaaccgtgggcggtttcggccagtgacggcacggcaaacgtgggcggatgctcaggccgcaatgtctcaatcagatgcatctgcgctttttcccgcgccagcgcatcgtctgcggtgatggggtggaagcggatggtgtcgccaggtttaacctggcctactttccacagctcggctttggcgatggtcaccggacagacaaagccgccgagactcgggccgtcgtgcgtcaggatcaccgggaagtcgccggtgaaattgaccgcgccaatggcatattcacagtcgtgaacgttggagggatgcaggcccgcttcgccgccgttggcgcgggtccaggtcggtttcgggccgaccagccgcacgccgaggcggttggagttgtagtgcacctgccagtcactggcgaagaacgcatcgatggcggcctgggtgaagaagtccggtgcgccgtgcgggccgtagagcacgccgatgcgccactcgctgccgtagtgcggaatcagcgccgcatcgagcggctgcggatcgctgaccggggcaggcgtggtgcaggctgcccgctcaggctgggagatcgccagcatatcggcaacccggagggtgcgtccggcgtgaccgccaaactggcccagcgaaaaggtgctgcggctgcccagatactccggcacgtcgaagccgttacgcacggccagatagctgcggcagcccgtccgggcgcgtcccagcgccagagtctctcccgctttcaccgccagcggctgccaggtgctgaccggttcgccctccagcgtggcgtcgcagtcagcaccggtcagcgccacgatggcatcacagtggaaacgcagcgtcggcccctgcagggtaaattccagccccgccgccgcgtcatgattaccgacgatgcggttagccagccggaaagcgaagtcatccatcgggccggaaggcggcacgccgatatcccagtagccgaggcggcctggatagtcctgaaccgaactgaaggtaccaagttgcagcacttccaccacggaggaggcaggcaccacgctgtcgaggtagcgcgtccagacgttgccgctgcgaaacgcgtcgctggcggtaatctggcgcagatagtcgaggttggtggcgatgccgtgcagctgagtggcatccagcgcatggcgaagtttttccagcgccgcatcgcgggtgtcggcatgcacgatcagtttggcgatcatcggatcgtagaagctggagacctcgctgccggtttcgatgccgctgtcgacccgtacgccgtcagggaaagttacgccggttagccggccggggctgggctgaaagttcttgagtggatcttccgcatagagccgcacttcaatggcggcgccctgcggcgcctgctgcagacgtgaccagtcaaccgcatcgcccgccgccacctgcaacatgcactccaccagatcgagtccggtgacgcactcagtgaccggatgctccacctgcaggcgggtgttcacttccagaaagtaaaaggcctgctggtcgacgtcgtagatatactccacggtgcctgcgctgcggtagttcacccgctcgccgagccgcaccgccgaggcgagcagggcgtcacgcgtcgccggagacaggccgggcgcgggcgtctcttccaccaccttttgattgcggcgctgcagtgagcagtcgcgttcacccagtgcgaccacagtgccgttaccgtcaccaaaaatctgcacttctacgtggcgggcgcgatcgatgcagcgctccagaaacacgcccgcatcactgaagaattgctcgccaagacggcgtacgctctcccaggcgctggcgagcgcaccggcgtcggcgcagcgcgtcaggccaatgccgccgccgcccgccgtgcttttcagcatcaccggatagccgatcttatcggccgcctgtatcgcctcctccagcgacgcaagcagcggtgtgccgggcgtcattggtacacccgcactggctgccagctcacgggcacggtgcttaaggccgaactcaccaatctgctgcgcggtggggccgacaaaggcgatccccgccgcttcacaggcttcggcaaacggctggctttctgaaagaaaaccgtagcccggccagatagcctgcgcgccgctctgctgagctgccgccagaattttgtcgatgcgcagatagctgtcgctggctttatcgccgcccagcgcgatagcgatatccgcctgcttaacgtgctgcgcgttgcggtcagtatctgaatagaccgcgacacttttgacgccaaggcgcttcagcgtccgaatggcgcgacaggcaatttcgccgcggttggcaatcagtacggtggtgaacatgatcagtgactcccctgtgatgccagccagttgcgccagccgcccgtctcagtaatctccagcgcgttgttcagcgccgcgccttcgcagataaagcctttcaccacccgcccatccgccagcgtcagactgccgatgcccagcggtgcgggaatctccgccacaaactcaccaaagcgcgccagcgggatatcccacagctccacggtgatagcggcgccctgttcgtcacgcatcaggccgggttttttgatcgcgccctccagcagggcaaacaggcgatagtgtggcgcggtcttcgtctcttccacccagacggcatggcgatcggtgagctgaaaattaagcggcattccggtgagatgcgcgcccaccaccgccagccggacatggtcggcggaggcgggcaggctggtgcgccaggcagggcagggctggccggtcgcgcccagtggcagagcaagctgctgctgccagcgaatgccaaactcagccagcgcccgatcgtgccaggcgggcgcaatcagcgtgatgcctgccgggagatcgtcattgcgaaacggtgcgggcagcgccagcgcggcgaggtcggcaaggttggtaaagttggtataggtgccgaactgcgagttgtagtgaatcggctcctgcttcatctcctccagggtatgaatcgtgggcgaggtcggcaccaccagcgcgtcaaactgtgccagcgtctgctgaatctggcgcgtcagttcggcccgcagatactccgccttataggcgtcgactgcgctgtatttcaggccgctggcgataatctcgtgtaccaccggatccatctccgccgggcgatcaagcatcccgcccaccgccgccgtgcgttcggcgacccatgcaccgtagtagagctgttcagccagcttccggaacggggtgaagtcgatagggtgcagcgtcacgccacccgcctgcaatgcctccagcgcctggtcccaggcggcttcggcggcggcatcatcaaaaaactccgggttcaaaggtaccgcaaaatggggatggacgggcaggctggccggggcggtgcgcggattaatgcgcgaataggcgtcaccggcatcatagccacccatgacgctggcgacgctaaaggcatcttctgccgtcaacgcaaacacggaaatcgtgtcgttgaggcggcaggcgggcaccacgccgcgtgcagagaaccagcccttggtcggcttcagtccgacaatattgttaaagcccgccggaacgcggcccgatcccgcagtatcggtgcccagtgaaaatgcgaccagcccgcgcgccagcaccgacgcggagccggagctggagccgccactgacgtaatcggcatcaaaggtgttactgaccgcgccaaacggggagcgggtgcccaccaggccggtagcgaactgatcgaggttggttttgccgatgactatcgcgccggcggctttcagccgggcgaccgctaccgcgtcttcgctggcggtataggtaaaggcggggcaggcggcgctggtcggccagcccgccacatcaatgttgtctttgacggcgaagggaacaccaaacagcggcagcgatccgggatcgcgctgatagtgcgccagcagtggctcaatctgagccgctaactgatccggtgtcgccagataaatccaggcactatcctggggatcgagtgccgccaagtgtgcgctcagcagcgaagtaatctgttgcggcgcctgctgatagcgctgctgccaggcgtgaagcgtcaggccaaaggttgaagtcatacgaagaattccagctggtatacaagatggaattcaacagagcaaaggctgtgccacttttttaacgcaatgattcaacagtttaatgcgtgcagtgataagattttctgatgataatttgcacaattacggcgcgcacgctgagcgatgacggtgcgtttacctttcgtgtgcgtaaattttgtgaagaacatggcaagagtccggtggcctggttagcatgaagactgtctggcaactcgccggccccagcaacagaggagatttacgtggtgaagtggcgtaactggataatagggatctgcatggccggcacggccagcagcgcatgggccgattcgcttgatcaacaacggcaacgttatcaacaaattaaacaggcctgggacagcaatcagatggccaccgtggatcagctgttgcccacgctacaggattatccgctctatccttatctgcaatatcgcctgctggcacaggatctcgatcaggagaccaccctggcggtacagaactttattcgccagtatccaacgttgccacccgcgcgttcgctcagcacccgctttattaatgtgctggcttaccgacaggactggcagggggtgctgaacttcagtccgactgaacctaagccggtgcaggcacgctgtaactggtattacgccaaatgggccaccggtcagcagcaggccgcgtttgacggcgcgaagcagatctggctgcgtggcacggcgctgcccgcggactgcgataagctcttctcggtctggcaggcgtccggtcagatttcgccaattacgatcctggagcgtatccggctggcgatgaaagcaggcaacgacagcctagtgagctatctggcgaaaacgttgccaactgactatcagaccatgtctgacgcgatacaggccctgcagcaggacccgttaacggtcagtaccttcgccagcgccgtcgggccaaccgactttacccgccaggcgacgatttacgcctttacgcgtgtggcgcggcaggacatggaaaatgcccgcagcctgattccgatcctggtccgggcgcagaagatggggccggaggatgagcaggcgctgaaggagattgtggtctggcgcatgatgggcagcgatctcacctctgagcaggcacgctggcgcgatgcggtggtgatgaacagcgagtctaccgcgctggtagaacgccgggtacgactggcactctctcagcatgaccgacgcggccttaacacctggatcgcccgtctgccgctggaagccaaagagaaagatgagtggcagtactggcaagccgatctgctgtttgagaaagatcgcaaagaggaagcggaagagatcctgcgcaaactgatgcaggcgcgtggcttctacccgatggtggccgcgcagcggctgggcgttgactacccgttgcaggtggatgaagcgccgaagcctgacagtgccacggtgcagggaccggagctggcccgcgtttcgcgagctgatgtactggggactggataacctggcgcgcagcgagtggagcaatctgatcggcagccgtacgcacacgcagcagcagatgctggcgcgctacgccaatgagcaggactggtgggatctcagcgtgcaggcgaccatcacggccaaaatgtgggacagcctgaaagagcgtttcccgctggcgtggcagagcgtctatgagcgcaataccgcggtgaagcagatcccgccgagctatgcgatggcgatttcgcgtcaggagagcgcctggaatccgaaagcgcgttcaccggtcggcgccagcggtctgatgcagattatgcctgccacggcggcgcataccgtgaagatgtataacatccctggctacagcaacaccagccagctgctcgatccggaaaccaatattcagatcggcacccagtatctggaatatgtctatcagcagttcaatcagaaccggattttcgcctcggcggcctacaatgccgggccgggccgggtgcgaagctggcagaaaaccagtgcgggcaatcttgatgccgtcgcgtttatcgagaccatcccgttctctgaaacgcgcggctatgtgaagaatgtgctggcgtacgacgcctactatcgtcacttcatgggcaagcctgacaagatcctgtcagatgctgagtggaatcgccgttactagctgtgctaagcttccgtactctttagcgagtacggaagcctcttcatgacccattctgattcccccaccgatgcgcatccggcagaagatagctggcaacgctttgtcgtgctgatgcagcaggcctttgctgatggtcatgcgctgccactgatgcaactgatgatgacgcccgacgagcgggaagcgttcggcacccgcctgcggattatcgaagagttaatgaacggcgagatgagccagcgtgaactgaaaaatgagctcggcgttggcattgcgaccattacacgaggctcgaacagcctgaaagaggcgccgccggagctgaaacgctggctggaggcgcgtctgggacgcgcctgatcactgctggtaaagcggatggatgaacgggcagagcgccagaatcagtgcctgatgatagacactggagcggctgagcaggccgtttgtgaacgccccgatagcgccaccctggtgtttgatattttcgatgccggttaaccgcgccatctcttcgcccagctcccgcccttcacgcagactcgccagcaccaccggcggcagggtgaaactggccgagcgcgattcgccgcgctgcttctgattttctaccaccatccaggcaaacgcgctgtcatcttcgatgcccgcctcaatcgctacccagaacgccgcttctggccggacctgccgggcattcatcacgcgctgacgtgcgccagttcgcgtttcgagatgggttaacggttgtgctgctacgccgctatcgacctcgaccccttcaatatggcaggatccctcgccgaaaacgtcgttgaatgcctgagcaatcgcatgaattttcgctggattggtggtggctgcgacaacatggtacataattggttgaaccctcaggtgattaagcgcctggtccatcgggctgtttgatttgtcattctgaacccgggcagtgctcacaatcctcacgtactttccgtacgcgccggttgtttcgcgctctccgtgtgcagactgactgcaacaatgacgcctgatggggtaagctctaaagcgatttttgtcgcagtataacggaaactaacatgctacaggtctatcttgttcgtcacggtgaaacggtatggaatgcggagcgtcgcattcagggtcagtccgacagtccgctgacggaaaaaggtgagcagcaagcctggcaggtgggtgagcgcgtgaaacatctgggcattacgcacattattgccagcgatctggggcgaaacgcgccgcaccgcggagattattgcggatgcctgcggttgctcagtcacgcttgatccgcggttgcgtgagctgaatatgggggtgctggagaagcgtccgctggatggcttaaccgcggaagaagagcagtggcgcgccacgctggtcaacggcaccgaagggggccgtattcctgaaggggagtcgatgactgagatggcgacgcgcatgcacgccgcgctgaatgcctgtcttgatcttcctgccggaagccgtccactgctcgtcagtcacggtatggcgctgggggcgctggtcagcacgattctcggtctgcccgcctatgcggaacgtcgtctgcgtctgcgtaactgctcactctcgcgtgttgattatcagcagagcgcctggctggcagaaggctggattgtcgagacggcgggggatatttcccatctggatgcgcctgcactcgacgagcttcaacgctgatctacttaaggctgccgtcgcgatgacggcagccttaacgtcagctggctacggtctggcggcgaatgggaatcagatattcgcaacggatctcggtcggtggctcagcgcgttttttaccgccatcggtgtaaaagcgttcgatgtcctgtccctgacggcgggtcagccccagcgtcggcatgcaggtgccatagagcagcagaataaactcctgcagattgacgcgcgggccggtataggtgaactgcacgtagtcgcccgcttccagaatcacgttctggccggagtgcaggttaaccgcgctgtcagcaggcaccgccgtggtgtagagaatctcctgctcatcatctttgtcctggctggcgcgcacctgatgcaggccatacagtaccggcggcaccgtgtcggtttccagcaggaactgcttccagaaatgaatacgcatttcgtcgcggtagctggaaatctgctccagaatacaggtgtagttctgggtttgtcctaccagcaccgtctccggtaaggtgacgaaagccggttccggctgcgtctcatcgtccagccgaataggggggcgaataccgaatgagttccagtcggaagagcggcgataccacgccggtgtctgagcaaactgcttcttgaatgcgcgagtaaaagtctgttgtgaatcaaaacgatactgcagtgcgatgtccagaatcgggcggctggtcaggcgcagcgccacggcggctttagacagacgacgcgcacgaatataggcacctattgcgtgtccggttacgtctttaaacatcctctgtaaatgccatttagagtaaccggctttctgggcaacattgtccagtgaaaggggttgatccagatggctctccagccagacaagcaaatcgcgaatgataccggcttggtccataaaacatcctcatactctggtggtacagctaaacgcattcgaagaatattagcactcattgctcaaaagacgtgggccgttttccggggaaggttgtgctaaatcagtacgggcttcaacccgttttggtttggtcattaactcgattaacagtacattacattctcatctattccatttgcaatggtaactccatgacaatattccgacttatgatcgctgcgctgaccacgctgaccttttccagcccgctgtttgccgaacagattggctctgttgatacggtattcaagatattcgggcctgaccacaagattgtcgttgaggctttcgatgatccggacgttaaaaatgtaacctgttatatcagccgggcgaaaaccgggggtattaaaggcggactgggtctggcagaagatacctctgatgccgcgatttcctgtcagcaggtgggtccggtcgaactgagtgataaaatcgctcagggcaaagcagagggtgaagtggtattccgccagcgcacctcattgatcttcaagaagctgcaggttgtacgcttcttcgacaaaaagcgcaacgccctggtctatctgacctattccgataaagtggttgatggctcaccgaaaaatgcgattagcgctgtgccaattatgccgtggcactgattatgccgtcacgctaaggacaaaaaaaacgcccgcaggggcgttttttatttgccgcgtctgacaggggcttaatcctgcaggtcaccgcagaagcgataaccttcaccatgaatggtggcgatgatctctggcgtgtccggcgttgattcgaaatgcttacgaatacgacgaatggtgacatcaacggtgcgatcgtgtggcttgaggtcgcggccggtcatttttttcagcagatcggcacgggtctgaattttgcccgggttttcgcagaagtgcagcatggcgcggaactcactgcgtggcagtttatagtgctcgccgttcgggttgatcagtgagcggctgttgatatccagctcccaaccgttgaacttgtagctctctacctgacgacgctcttcgcctggcatggccagattcatggtgcgcgacagcagattgcgggcacgaatagtcagctcacgcggattaaacggtttggtgatgtagtcgtcagcgccaatttccagaccaagaattttatcgacttcgttgtcacggccggtcaggaacatcagggcgacattggcctgctcacgcagttcacgggccagcaacaggccgtttttaccgggcaggttgatgtccatgatgaccaggttaacgtcattgtcggtcagcacctgatgcatttcagcaccatcagtcgcctcatacaccacataaccttccgcctcaaaaatactcttgagggtattacgcgtgaccagttcgtcttcaacgataagaatgtgcggggtctgcatgtttagctacctaaaatttgccaacaaattgaaaacagggcgtacagcggtatggcgtttctccatcatcgagagcggcgggccgcgctgaaccgttgtacgaaatcatattttgataagccatctatcaacgtcaacaacagtattagctcagccagtcaggatgaaaattgcatgccccgggcgttaatgataatggcgcatatcctaactgtattaacagcaacctaacagcaccaactacaaccgataagcataaaaacaacgcttcgttgacttatatcaaatgcaattgtagcacgttaacacttttgtgaaaaacttctcgcagattgcctgtttagctcacaaaaagcatcattttcgttacattttttacgcagtcgggccaaaataaaacccgccggaaatcacattctatctcgttgaagttaaatggtttaataatgatttctttaataaagctcgtttcagggataaaaagattcaggccatcacttttaaccagttttaacatggttaacacacgattttcttaataccttctggcgactgaatcattaacagccatgttaatatggcgttatgttaatggaccaatggaataaatatgctttttcccctgattctcgtctcgcccgcgcggccagaaaatatcggcgctgcggcgcgtgccatgaaaaccatgggattcagccagctgcgcatcgttgccagtgacgcctggcaggatcccgcagcgcgccgggtggcacatggtgccggcgaaattctcgacaacgttcagacctttgcaaccctggccgacgcgttagcggacatcgatttttcggtcgcgaccaccgcgcgcagccgggcaaagtttcgttattacgccacaccggagcaggttgaaacgcaactgctggagaaacgccagtgggtaaacagtatggcgctggtgtttggccgcgaagatagcgggctgaccaacgaggagctggagcttgtagacctgctgaccggcatcccgatggcgaatgactatccttcactcaatctcggacaggcggtgatggtctactgctatcagctgtcgaagctgaatcaggttgaggcatcaaaagcctctgcggcggatgggcagcagttgcaggcgctgcgtcagcgtttccatcagctgctggcacaactggaggtcagtgatgatgagaagctgtcagactggatcgatcagcgggtggggctgctggaacagcgcgacagtgcgatgctgcatcgtctgctgcacgatattgaaaaaaaactcacagataaatcctcggcaaaaagctgattttacagcaacagatcgcagggaatttctgcatcgcaaccgatcgaacagcgttttacgctttcaccggtggctgtgcgcagtggtggaaatctgtccgccggacaaatcgggttgacttaatgtgcgctttgctttacttctggaagcaagacggacagacaaaaacagacagaaaataaatctaaatgcgtaaaatcagcctgaacaccacaattattaccaccaccattaccacaggtaacggtgcgggctgacgcatacaggaaaaacagaaaataagcccgcacctaaacagtgcgggcttttttttcggcttaaattcaggagagtttatattatgcgagtgctgaaattcggcgggacctcggtagcgaatgcagagcgatttcttcgcgtcgctgacattctggaaagtaatgcgcaacaaggacaggttgcaaccgtgctctctgcgccagcaaagatcactaaccatctggtggcgatgattgaaaaaaccatcagtggtcaggatgctttgccgaatatcagcgacgccgaacgcatcttcagcgagctgttgcagggactggctgacgcgcagccgggctttgagtacgatcgactgaaaacccgcgttgacctagagtttgcgcagctgaagcaggtttctgcacggtatcagcctgctggggcagtgcccggacagcgtcaacgcggcgattatctgccgcggtgaaaaactctcgattgcgatcatggaagcgctgctgcaggcgcgcggccatgaggtcagcgtgatcgatccggtggaaaaattgctggcggttggccactaccttgaatctactgtcgatatcgccgaatcaacccgccgcattgaagcaagtcagattccgccgcagaacatgatcctgatggcgggcttcacggctggtaacgagcgaggcgagctggtcgtactgggccgtaacggttctgactattcagccgctgtgctggccgcctgtctgcgcgccgactgctgtgaaatctggactgatgtggatggcgtctatacctgcgatccgcgtcaggtgccggatgcgcgcctgctgaagtcgatgtcctatcaggaggcgatggagctctcctatttcggcgccaaagtgctgcatccccgcaccatcgcgcccattgcccagttccagatcccctgcctgatcaaaaacacggccaatccgcaggcacccggcaccctgattggagcagaaggcgaacaggatgagaacccggtaaaaggcatcaccaacctgaataatatggcgatggtcaacgtctccggtcctggcatgaaagggatggtcgggatggcggccagagtctttgcggcgatgtcgcgcaccggcatctcggtggtgttgatcacccaatcctcttccgaatacagcatcagtttctgcgtgccgcagagcgagctggcgcgggcgcgtcaggtgctggaggaggagttctacctggagctgaaagatggcctgctggatccgctggatatcattgaaaacctggcggtgatttcagtggtgggcgatggcatgcgcacgctgcgcggcatttcagccaaattcttctcggcgctggcgcgcgccaatatcaatatcgtggcgattgctcagggctcctccgagcgttcaatctcggtggtggtgaacaatgatgaagtgatcaccggggttcgcgtggtgcatcagatgctgttcgccaccgatcaggtaatcgaagtgtttgtggtcggcgtcggcggcgtcggcggcgcgctgctggatcagttacatcgccagcaggcgtggctgaagaaaaagcatatcgacctgcgcgtctgcggcatcgctaactcccgtgcgctgttaacccacgtccacggcatcgatttaagcaactggcaggcggcattaggcgaagcgaaagagccgttcaatctcggtcgtctgacccgtctggtgaaagagtaccacctgctcaatccggtgattgtggactgtacttccagccaggcggtcgccgatcagtatgctgattttctcagcgaaggtttccatgtggtgacgccaaacaaaaaggccaacacctcatcctggaattactatcagcagatgcgagccgccgctgccaaatcgcggcgtaaattcctctatgataccaacgtcggcgccggactgccggtgatcgaaaacctgcagaacctgatgaacgccggtgatgagctgctgcgcttctccggtatcctctctggctcgctgtcctacattttcggccagctggatgacggaatgtcactgtcgcaggcgacaacgatggcgcgtgagatgggctttaccgagcccgatccgcgtgacgacctctccggcaccgatgtggcgcgtaagctgctgatcctggcccgtgaagcgggtcatcagctggagctgagcgacattgagattgagccgctgctgcccgccagcctgaccgaaatccaggacattgagcagtttatgcagcgtctgcctgagctggataacgcctttgccgcccgggttgcgcaggcgcaggatgagggcaaagtattgcgctatgttggcgtgattgaagagggcggcatctgcaaagtgaagatcgacgccgttgatggcaacgatccactctataaggtgaaaaacggcgagaatgcgctggcgttttacagccgctactatcaaccgattccgctggtgctgcgcggatacggtgcaggaaatgatgtcacagcggccggtgtctttgccgacctgctgcggacactgtcatggaagttgggagtttaatcatggtaaaaatttacgcaccggcctcgattggtaacgtcagcgtcggcttcgatgtgctgggcgcggcggtttcgccggtagatggctccctgttgggtgactgcgtctccgtggaagcggcagagcagttttcactgaccaacgccggacgttttgtcagtaagctgcccgccgatccgaaagagaatattgtttaccagtgctggcagcgtttctgccaggaaatcggcaaagcgatcccggtggcgatgacgctggagaagaacatgcccatcggctccgggctgggttccagcgcctgctcggtggtggccggtttaatggcgatgaacgagttttgcggcaagcctctcagcgacagcacgttactgaccctgatgggtgagctggaagggcgaatctccggcagcgtgcactatgataatgtcgccccttgcttcctcggcggcattcagctgatgctgcaggagaatgacattatcagccaggcggtgccgggctttgatgactggctgtgggtgatggcctatccgggcattaaagtttcgaccgcagaagcgcgcgccattttaccggcgcagtaccgcaaagaggactgcatcaggcatggccgtttgctggccggcttcattcacgcctgccatacgcgtcagccgcagctggcagctaaacttatgcaggatgtgattgccgaaccttaccggacccggctgctgccaggcttcaccgaggcgcggcaggccgcgaaagatattggcgcactggcgtgcggtatctcaggctctggtccgacacttttcgccgtttgcaatcagatggaaacggcacagcggatggctgactggctgagccagcactatctgcagaatgatgaaggcttcgtccatatctgccgtctcgacacggctggcgcacgacaattgggataacgcatgaaactctacaatcttaaggatcacaacgagcaggtcagcttcgcccaggcggtgaaacagggtctgggttcgcagcagggtctgttctttccgctggaactgccggagtttgaactgaccgacatcgacgcgatgctggagatggattttgtcagccgcagcagcaaaattctctcggctttcattggtgacgagattccggcccagcagctgcatgagcgtgttaaagccgcttttgcttttccggccccggtgaaagccgtcagcgaagatatcgcctgtctggagctgttccacggcccgacgctggcgtttaaagatttcggcggccgttttatggcgcagatgctgtcgtatgtctcaggctcagatgagcagatcaccattcttaccgccacctccggtgataccggcgcggccgtggcgcacgccttttacggcatgaagaaacgtgcgcgtggtgatcctctatccgcagggcaaaatcagtccgctgcaggagaaactcttctgtaccctgggcggcaacatcgaaaccatctctatcgacggcgattttgatgcctgccagtcgctggtgaaacaggcgtttgatgatgaagagctgaagcgcgcgattggcctgaactcggctaactccatcaacatcagccgcctgctggcgcagatctgctactactttgaagcggtcgcgcagctgccacaggaaaaacgtaatcagctggtggtgtcagtgccgagcggcaactttggtgatttgaccgccggtctgctggcgaaatcgctgggcctgccgatcaaacgctttatcgccgccaccaacgccaacgacacggtgccgcgcttcctgggcaacggcgagtggcagccaaaccagacggtctctacgctgtcgaatgccatggatgtcagccagcctaataactggccgcgtgtggaagagctgttccgccgtaaaacctggcgcttaaccgatctggcctgtggtgcggtctcggatgagaccacgcgcgccgccatgcgtgaactggctgagatgggctacatttccgagccgcatgccgccatcgcctggcgtctgttgcgcgatcagctgcaggaaggggagtatggtgtgttcctgggaaccgcgcatccggcgaaattccgcgaaagtgtggaagcgatccttgaacagaccctgacgctgccgccggagttagcggagcgcgccgacctgccgctgctgtcgcatcagatgaagggtgatttcgcctcgctgcgggcgtttctgctgaagtaaacctgtgaaaggcttcccggttgcgggaagcctgtttgtggaaagcagagggcgcggggtgttactgctctgcgcgcttaaagaccagctcgctctcgctgctgctggctgcatcaaaacgatagccatccagatcaaacgccttaagctgttccggcttcgtcaggcgctgctgaatcacatagcgactcattaatccacgcgcctttttggcatagaagctaatcactttgtaactgccattcttctcgtcgaggaacaccggcttaatcatctgtgcccgcagcgtcttcggcttaaccgcccggaaatattcgtccgaggcgaggttgatcagcacctcatcgccctgttccgccagcgcggcattcagcgtttcagtgatgagatcgccccagaaggtgtagagatctttgcccgccggattcgccaggcgaatgcccatctccagacggtaaggctgcattaaatcgagtggacgcagtacgccatacaggcctgataacatacgcaggtgctgctgagcaaaatcgaaatcctgatcgctgaaggtctctgcctgtaaaccggtgtagacatcacctttgaacgccaggatagcctgacgggcattcttaggggaaaaatcgggctgccagctgttaaagcgctcggcattgaggtgcgccagtttatcgctgatgtccattaacgaggcgatgctggcgggtgacagctcgcgcgcaatttcaatcagctgttgtgacttttctaacagcgcaggctgggtgaaacgcgttgtcgccagcgggctttcataatccagcgtcttggcgggagagatcaccatcaacatagttgcttcctcggttaatgcctggtttaacagggcattggctgcttatcaggcttcgcagtgtaccaaaaaagccgcaaagaatgacgaatcacacctatttgttcgcgctatcgtaaacggcattccctgaccttgcgccaccgttgccgcgtgatattatcgcaacagccttttttcacactgacagttaactaagagaaaagaacatgacggacaaacttacctccctgcgtcagctcaccaccgtcgtcgccgacaccggtgatattgcagccatgaagctgtatcagccacaagacgccaccaccaacccttctctgattctcaacgccgcgcaaattcctgaataccgtaaactgatcgatgaagcgatcggctgggcgcgtgagcagagcagcaacaaagaagagcagctgcagctggtttctgacaagctggccgtgaacattggtctggaaattctcaaactgatcccaggccgcatctcgacggaagtggatgcgcgtctctcttacgacactgaaggcagcatcgccaaagcccgcagcctgatcaaactctacaatgatgccggtatcagcaacgaccgcatcctgatcaaactggcctctacctggcagggcatccgtgctgcagagcagctggaaaaagagggtatcaactgtaacctgacgctgctgtttctcctttgctcaggcgcgtgcctgtgctgaagcgggcgtgttcctgatctctccgtttgttggccgtatcctcgactggtacaaagccaacaccgacaagaaagagtatgccgcgcacgaagatccaggcgtggtttcagtttctgaaatctacaactactacaagcagcacggctatgaaaccgtggtaatgggcgccagcttccgtaacgtcggcgaaatcatcgagctggctggctgtgaccgtctgaccatttctcctgcgctgctgaaagagctggcggagagcgaaggcaccctggagcgtaaactgagctacagcggcgaagtgaaagcgcgtccggcccgcatgaccgagtctgagttcctgtggcagcacaaccaggatccgatggcggttgcgaagctggcagaaggtatccgcaattttgccgttgatcagggcaaacttgagaagatgctggcagaactgctgtaatctgttgaccgtggcggcgcaggctgccacggttttcccttttccgaccctttcactttatattatcctctcggctattccccttttactccaaccgcaccgcggtaaatcacagcgaagctaatcatgaatacattacgcattggcctgatctcggtctccgatcgcgccgcgaacggcatttatcaggatcagggtattcccgcgctggagagctggctcggcagcgcaatcagcagcccgtttgagattgagtcccgactggtgcccgacgagcagccgatgattgagcaggcgatttgcgaactggtcgatgaacgtttttgccatctggtgttaaccaccggcggcaccggtccggcccgacgcgatgtcacgcccgatgccaccttagccgttgccgatcgtgaaatgcctggttttggtgagcagatgcgccagatcagcctgcagttcgtaccgaccgcgattctgtcgcgtcaggtcggggtgatccgcaagcagtctctgatcctcaatctgcctggtcagccgaagtcgatcaaagagacgctggaagggctgaaggatgagcagggcaacgtaaaagttcacggcatctttgcatctgtaccttattgtttacagttgctggaagggccttacgtcgaaacgcattccagcgtagtagcagcatttcggcctaaaagcgctatacgtgagataaataactaaatattccccatttcaggcataagctatagccttgctggtgtggcaaaagattgacggtatagtaataagatctttacaactttatctcttttgcctctggaatattatgaatccgactcacactcagcgtctgaccggtaaggattacaagaccctggcgctggccgcgctgggcggcgcgctggaattctacgacttcattatcttcgtcttcttcgccaccgtgattggcgaactctttttcccctcggatatcccggaatggctgcgtcagctgcagacgtttgccatttttgccgcaggctatctggctcgtccgctgggcggcatcgtgatggcgcattttggcgataagctcgggcgcaaaaagatgttcagcctgagcattctgctgatggcgctgccgaccctgatgatgggcgctttacccacctggcagacgattggcattgctgcgccactgctgatgctgctgatgcggatgttacagggcgcggcgattggcggtgaagtgccgggcgcctgggtgtttgtcgcggaacacgtgccctataaacgtatcggcatcgcctgcggcacgctgacggccgggctgactatcggcattttactggggtcgctggtagccacgctgatcaatacctcaatgtcgcagcaggcgatccatgatggcggctggcgcatcccgtttcttcctcggcggcgtgttcgggctgatcgcgatgtacctgcgtcgctggctgcatgagacgccagtgtttatcgagatgcagcagcgtaaagcgctggcggaaactctgccgctgaagaccgtgctggcagagcataaaaagtcgattgtcatctctatgctgctgacctggctgctctccgcctgcatcgtggtggtgatcctgatgtcgccggtctggctgcaaaaacagcagggcatcgcgcctgcgctgaccctgcaggccaacagcatcgccaccgtgatgctctgcattggctgcattattgccggactcgcggccgatcgctttggtgccagtcgtacgctgtgtgtcggcagcctgctgctggcgatctgtagctggcagttttatcacctgaccgccctctatccacagcagctcttcctgctttatggcgtggcgggtctcagcgtcggtatcgtcggcgtggtgccctttgtgatggtgcgcgcctttccggcagaagtgcgttttaccggactctcattttcctacaacctctcctatgcgatctttggcgggctgacacccatctttgtgtcgctgctgatgaacgtctcagagatggcaccctgctggtatgtgatggcgctggcgctggtaggattgctgacggggatctggctgcggcgtgatgtcagccacgagcctggcctgcagcaggggattaactctttgtaatgcggggacgcggagcctggctccgcgtctttttttatgtgtaaaagcaggcttaaagcgatttcgcgccaatcggcagaatagtgcggccaaaggtttcgttcagcacttcacccatcgccagatagcaggcgctggctccacagagtatcccgacccagcccgcggagaccaccagcgccggcaggtgcataagatgggccacggccagcagcagaaacagcagcgagagcgagccgaaaacaaactgcagcatccgcgcacctctcagcgtaccgacgaacataaacagcgtgaaaatgccccacagtgccagccaggctcccaggaaacgttcgtctggcgcttttgccagacccatttcaggtaacagcagaatcgccacaaagcttaaccagaacatgccgtaagaggtaaaggcggtcagcccgaaagtgttgttctttttaaactccagcagaccggccagcacctgtgcaatcccgccataaaaaatgcccatggctaaaatcgccacgtccatggcaaacaggcccgtgttgtgcaggttcagcaaaatggtcgtcatgccaaatcccattaatcccagcggggcagggttagccagcgttgaatttgccatagttcctcggcagtaaaatgatcgttgatgtaataaacggatttcgtcctgctccctgaggggaacaaggcgacgcatcatattcagcgttgtggcagcgtttctttgatcccgacagggccaaaggtaaaaatttttttttggtttagcccttgatgcgcatcgaagcggccccatttacttgtcatagagcgttgtgaacgttggaaaaaaagcatgtgctggcagttgaatgcaaacaacccgcccacataaaaggttcacaacccaaattggcaacgaatttaagtgggagatgtttagatgggtaagattattggtattgacctgggtacaaccaactcttgtgttgcgatcatggatggcactaaagcacgcgtgctggaaaatgccgagggcgatcgcaccacgccttcaattattgcgtatacacaggatggcgaaattctggtcggtcaaccggctaaacgtcaggcagtgaccaacccgcagaataccctgttcgcaattaagcgtctgatcggtcgtcgcttccaggacgaagaagtacagcgtgatattaaaatcatgccgtacaaaattaccggcgctgacaacggcgacgcatggctggaagtgaaaggtcagagaatggcaccgccgcagatctctgctgaagtgctgaagaaaatgaaaaagaccgccgaagattacctcggtgagccagtgactgaagcggttattaccgtaccggcttacttcaacgatgcgcagcgtcaggcgaccaaagacgccggccgtatcgcgggtctggaagtcaaacgtatcattaacgaaccgactgctgctgcactggcatacggtctggataaaggccagggtaaccgcaccatcgcggtttatgacctgggtggcggtaccttcgatatctcaatcattgagatcgacgaagttgacggcgaaaaaacctttgaagttctggcgaccaacggtgatacccacctgggtggtgaagacttcgatagccgcctgattaactatctggttgctgaattcaagaaagaccagggcatcgatctgcacaacgatccactggcgatgcagcgtctgaaagaagcggcagagaaagcgaaaatcgaactttcttctgcacagcagaccgacgttaacctgccatacatcacggcagatgcgaccggtcctaaacacctgaacatcaaagtgacccgctctaaactggagtcactggttgaagatctggttgctcgctcaatcgcgccactgaaagttgcgctgcaggacgccggactgtctgtttcagacatcaacgacgttatcctggtgggtggtcagactcgtatgccactggttcaggccaaagtgactgagttcttcggtaaagagccacgtaaagacgtgaacccggatgaagcggtcgcggtcggtgctgcagtttcagggtggtgtactgggtggcgacgtgaaagacgtgctgctgctggacgttaccccgctgtcactgggtatcgaaaccatgggtggtgtgatgacttcgctgatcagcaagaacaccactatcccaaccaagcacagccaggtcttctcgactgctgaagataaccagtcagccgtgaccattcacgtgctgcagggtgagcgtaagcgcgccaatgacaacaagtcactgggccagttcaaccttgacggtattcagaacgcgccacgcggtctgccgcagatcgaagtgaccttcgacatcgatgcggatggtatcctgcacgtgtcggcgaaagataagaacagcggtaaagagcagaaaatcaccatcaaagcctcttcaggtctgagcgatgaagagatccagaaaatggtgcgtgatgcggaagcgaacgctgaatctgaccgcaagttcgaagagctggtacagacgcgtaaccagggcgatcagattgcccacagcacgcgtaagcagctggaagaagcaggcgacaaactgtcagctgatgacaaaacgccaatcgaagccgctctggccgcgctggaaactgcgctgagaggcgaagacaaagcggaaatcgatgccaaaatgcaggcgctgatggaagtgtccggcaaactgatggaagcagcacagcagtctcaggcgggtgcagcggatgccggtgacgcgtcagcgaagaaagatgacgacgttgtcgatgctgaattcgaagaagtgaaagacaacaagaaataattgcccctgaccgggcgcgacggttggcctgacagccgttgaaaccagcacgggcgtaggagatctctccacgcccgtgcgatcatgttaagggctaaataaacatggcgaagagtgattactacgagattttaggcgtcgccaaatccgcggacgagcgtgaaatcaaaaaggcttacaaacgcctggcaatgaaatttcacccggaccgtaatcccggtgacaaagaagccgaagccaaattcaaagaggtcaaggaagcgtacgaaatcctgaccgatgcgcagaagcgtgcggcctacgatcaatatggtcatgcagcctttgaacagggcggtatgggtggcggtggatacggcggcggcggctttggtggcggcggcgcagacttcagcgatatctttggcgacgtgttcggtgacatctttggtggtggacgccgtcagcgcgcctcccgtggcgccgatttacgctacaacatggagctgtcgctggaagaagcggtacgcggcgtgaccaaagagatccgcattccaacgctggaagagtgtgacgtctgccacggcagcggcgcgaaagcgggaacgcagccacaaacctgttcaacctgtcacggtgcaggccaggtgcagatgcgccagggcttcttcaccgttcagcaggcctgtccgacctgtcatggtcgcggctcggtgattaaagatccgtgcaacgcctgtcatggtcatggccgcgttgagaagtcgaaaacgctgtcagtgaaaatcccggcaggggtcgacaccggcgatcgcattcgtctcagcggcgaaggcgaagcgggcgagcagggcgcaccagcaggcgatctctacgttcaggtctcggtgaagaaacacccgatcttcgagcgtgaagagaacaatctttactgtgaagtgccgatcaactttgcgatggcagcgctgggcggtgagattgaagtaccgaccctggatggtcgcgtgaagcttaaagtgccgtcagaaactcagaccggcaagctgttccgcatgcgcggacgtggcgtgaaatctgtgcgtggcggcgcggtcggcgatctgctgtgtcgtgtcgtggtggaaacaccggtcagcctgaatgagaaacagaaagcgctgttgcgtgaactggaagagagttttggcggcccgagcggcgagcataatagcccacgctccaagagctttttcgacggcgtgaaaaaattctttgatgatctgactcgttaagtctgcctgataaaaagcggagctccggctctgatgccagtcagttaagcgacaggtgataacgcagtctggtgccgcgcaggggctggcggtcctcgcgccgctgcgcggttccttcacttcattcctctgcctgacggaccggcggggatggcacatcctgtgccgccccgcctttcgcccgcgtcctgcgggctctcctggcagactcattctgttcagcgctgcggattacctgcccctgcccgaccccagcctgctctgaaacttcagtgtgtagtgttaaaaagggcacgagagtggaggcctgagcgcctctgctgctgaaagggctatccgcagcgctgaggcgtgacggtgggccagaagtccacgccgggaagcgtggacagttcggggccggccagggagggccgatccccgaacggttcgtcggcacgccgtcaaagccgaaggtaccgcgtgagcggcgcgaggacggcccggcagcagcagaggtgctcaggcccgcactgcggctcgctcgcccggaaaaaaagctgccacgtctgaccgtgacagcctttacaaatctaatcttaactgaccagcattggagccccggctccgctttttttactttaaatcccctgcctgtgatggctgcattatctctccctcaccgcagcactcataaaaatgtcgacgtttactgctattactgctcggcgaaacagagcatatagcgcggtataagctgcttttaacgaactatatgaatcgttacactgtttaacattctgtctctgctcaggaagatgaacgttgaacaagccgcgcaaattaaaaaatctgctaaaaagttttattgaaagtgatgccagcaatggcgtgatgttgatcgtggcggcggtcgcggcgatgatcctcgccaatacggccgctaccgcccagggttaccaggcgttgctgaatgaaccggtacaaatccgcttcggagcgctggatatcagcaaaaacttgctgttgtggatcaacgatgcgctgatggcgcttttctttctggttattggcctggaagtaaagcgtgagttgatggtcggcgaacttgccagccgtgacaaggcgatcttcccggtcatcgcggcaataggcggcatggcgttacccgccctgatcttcctgcttttcaaccatggtgatgagattgcacgtaacggctgggccattcccaccgcaaccgatatcgcttttgcgctgggtgtgctggcccttctgggcagccgtgttcccgttgcgctgaaagtctttctgatggcactggcgattattgatgacctgggtgccattgtgattatcgctctgttctataccagtgacctctcagtgctctccctgtgcgtggctgctggcgcaattgtcgtgctggcactcctgaaccgctttaacgtccgtagaatctcagtctacatactggtgggtatcatactctggaccgccgtgctgaagtcgggcgtccacgcaaccctggctggcgtcattgtgggcttcttcgtgcctctggagaagaaagaggggcactctccagcggaacatctggcgcatggtctgatgccgtgggtgaactggatgattctgccgctgtttgcctttgctaatgccggtatctcacttgctggcattacgctgagtgatgtcctctcgcctgaaccgtcaggcatcatcttcggcctgttaatcggtaagccattaggcattacgctcttctgctggctggcggtaaaactgcggctggcagtattacccaacggcacaaccatacgcgatattatggcgattggtgtgctgtgcggaattggcttcactatgtcaatttttatcagtttcgctggcctttgatgccgcgcatgaacagctggtgaccttttctaaactgggcatactgaccggctctctgctttcagccgtcatcggctatacgctgctgcgaattaaactgcgttaatggggaggaggcgaaagcctcctttttgctatgaatcagctcaatttcaatcatctctactactggcacgcctgccgtgcgggatcaattacggcggcagcagaggcactctccctgacgccgcagaccattaccgggcagattaaggcactggaggagcgcctgcagggcaagcttttccggcgtcagggacggggcctggtaccgactgaactggggcagctggtttttcgctatgctgaccgcatgtttatgctgagtcaggagatgctggatattgtgaattaccgcaaagagtctcatctgctactggatgttggcgtggcagatgcgctctcaaagcagctggtcagcaaggtgctggagacggcggtggtcgcagaggagaaaattcatctgcgctgttttgaatcgacccacgaaatgctgctggagcagctcagtcagcacaagctggatatgattatctctgactgctccatcgaccccacccaacaggaagggctattttcggtgaagctgggggaatgcccgatcagcttctggtcaacccagccgctcagcgatctctcttttccggcctgcctggagacgcgtcccctgctgattccggggcgccgctccatgctggggcgcaaaatcctcaactggatcagcacccagggagtgcaggtggagattctcggtgagtttgatgatgcggcactgatgacggcgtttggtgcgcgacagaatgcgatttttgtcgcgcctttgctggagatgggtcaacgtgaggggatatatgaagtcgggcggctcgacgcggtatcagaggagtatcacatactcttcgcggagcggatgattcagcatccggcggtgcagcgactctgtcacgcagacttcagcgaactctttccccgccaggggacagacgaaaaaaaaccggcgtaagcgccggcttttttaacaaagcgattaacaacaggcgattaagccagtttgttgatctgtgcagtcaggttagacttataacgtgcagctttgttcttgtggatcagacctttagcagcctgacggtccacgagtggttgcatttcattgaatgcgttctgcgcagcagctttgtcgcctgaagcgatcgccgcgtatactttcttaacgaaggtacgcatcatagagcggcggctagcgttatgcttacggcgtttctcagatgttacggcgcgtttcttagctgatttgatattagccaaggtacaactcccaaatgtgttctatagagacaaatcaaaggccgaggactatgcccttctaacctgattttgtcaatggatttgtgcaaataagcgtcgccctgagagcggcactcggttacgtatttgatggcgcaggattctaccagcttcccctcgctgaatacagtatttcgcgacaaaattcttaacatgcgcttctgcaacaggaaatgcagcgcctaaagcatgaaaggcgtgctgacgggttaacctgagtcgctttcaagggtataatccgccgatttccaccggtttgggccagccatgaagtttatccgcggtattcataatcttaacgagcagcatcgcggctgcgttctgaccattggtaatttcgatggcgtgcaccgtgggcatcaggcgctgatgtcgcggctgtgtgaagagggacgtaagcgcaatctgccggtggtggtcatggtttttgagccacagccgctggagctgtttgccggtgacaaagcgccggctcgtctgacgcgtctgcgtgaaaaactgcgatacatggcggaagccggcgtcgataaagtgttgtgcgtgcggttcgaccgtcgctttgcggccttgtccgcccagcgttttatcagtgacctgttagtcgaaaagctggacgtaaagtaccttgcggtaggcgatgatttccgcttcggcgctggtcgccagggtgatttcctgttattacagaaagccggtgcggagtacggctttgaggtcgtcagcaccgaaaccttctgtgatggcggtaagcgaatcagcagtactgccgtgcgtcaggcgctggccgtggatgatttagcgctggcgcagtcgctgcttggtcaccctttcactatttccggccgcgttgtgcacggtgatgcactgggacgcacgctgggtttccccacggcgaacctccctttacgccgcagcgtctcgccggtgaaaggggtttatgcggtagaggtacggggtctgacgcccgagccactgccaggtgtcgccaatatcggcacccgtccgaccgtaaaaggtttacgccagcagcttgaagttcacctgctcgacatcaatatggatctctatggtcgtcacattgatgtggtgctgaaacagaaaatacgaaacgagcagcgctttgcctcactggaggcgttgaaagaacaaattgcgaacgatgtggtaacggcccggcagttctttgggctgctttaacctgagcgaaaaacggaatcgagaatctgatgagtgactataaatctaccctgaatttgccggaaacgggattcccgatgcgtggcgatctggccaaacgcgaaccgggaatgttgcaacgctggtatgccgacaatctgtacggcatcatccgcgaagccaaaaaagggaaaaaaacctttatcctgcatgatggccctccgtatgcgaaacggcagcattcatattggtcactccgttaacaagattctgaaagacattatcgttaagtcgaaaggcatggcgggttatgattcgccgtatgtgccgggctgggactgtcacggtctgccaatcgaacacaaagttgagcagatgatcggcaagccaggcgagaaagtcaccgctgctgaattccgcgaagcgtgccgcaaatacgccgcagaacaggttgaaggccagaaggcggactttatccgtctgggcgtgctgggcgactgggatcgtccttacctgaccatggatttcggtaccgaagccaacatcattcgtgcgctgagtaaaatcatcggcaacggccacctgcacaaaggcgctaagcccgtgcactggtgcctggattgccgttctgccttagcagaagcggaagtggagtattacgacaaaacgtcaccgtcgattgatgtgatgttcaacgccattgatgccgacgcggtgcgtcaggcgtttggtgtggcacaggttaatggtccgatttcactggtgatctggacgacgacaccgtggacgctgccagctaaccgcgccatctcgttaaacgcggaatttgagtatcagctgctgcagatcgacggtcgcgcgctgatcctggcaaaagatctggtcgagagcgtgatgaagcgcgcgggcgtcagcgaatggcaggtactgggcgaatgcaaaggcgcggcgctggagctacagaaattccagcatccgttcctggcgcttgagtcgctggtggtgctgggcgatcacgtcaccctggaagcgggtaccggtgcagtccacacggcacctggccacggtccggatgactatgttatcggtcagaaatatggcatcgaaaccgccaatccggtcggaccggatggccgctatctgccaggcacctatccgacgctggatggggtcaacgtctttaaagccaacgacatgatcgttgagctgctgaaagagaagggcgcgctgctgcacgttgagaaactgctgcacagctacccgcactgctggcgccataaaacgccgatcatcttccgcgccacaccgcaatggttcatcagcatggatcagaaaggattgcgtgcgcagtcgctgaaggagatcaaaggcgtgcagtggatcccggactggggccaggcgcgtatcgaatcgatggtggcgaaccgtcctgactggtgtatctctcgtcagcgtacctggggcgtaccgatggcgctgttcgttcataaagagagcgaagagctgcacccggacacgctggcgctgatggaaaaagtggcgcagcgcgttgagcaggaggggattcaggcctggtgggatctcgatccgcgcgagctgatgggcgacgatgccgatcattacgtaaaagtgccggatacgctggatgtctggtttgactccggttcaaccagctattccgtggttgatgcgcgtccggaatttgacggacatgcgcctgacctctatctggaagggtccgatcagcatcgcggctggtttatgtcctcgctgatgatctccacggcgatgaagggcaaagcgccttatcgtcaggtactgacacacggtttcaccgtggatggtcagggccgcaagatgtcgaaatcgatcggtaacacggttgcgccgcaggatgtgatgaacaaactgggcgccgatattctgcgcctgtgggtggcatcaaccgactactcgggcgaaatggcggtctccgatgagatccttaaacgttctgccgatgcctatcgccgcatccgtaacaccgcgcgtttcctgctggctaacctcagcggctttaacccggcgaccgatctggtgaaaccggaagagatggtggtggtggatcgctgggccgtcggtcgcgctcaggcggcacaggccgatatcgttgcctcttacgagaactacgatttccacgaagtgatccagcgtctgatgcagttctgttcaattgagatgggcagcttctatctcgacatcatcaaggatcgtcagtacaccgcgaaaggcgatggcctggcgcgtcgcagctgccagaccgcgctgtggcatatcgtcgaagcgctggtgcgctggatggcaccgatcatgtcctttacggcggatgagatctggggctacctgccaggcgaaacgtgcgcagtatgtctttaccgaagagtggtatcaggggctgtttggcctggctgaagatgaagcgctgaatgacgcctactgggctgagctgctgaaagtgcgtggcgaagtgaacaaggtgatcgagcaggcgcgtgcggataaacgtatcggtggcgcactggaagcaacggtcacgctctatgccgatccggagctggcggctaaactgcaggcgctgggtaatgagctgcgctttgtgctgctgacctctggcgcacaggtggctgattacgccctggcgaacgacgaagcgcagcagagtgagctgctgaaaggtctgaaaatcgcgctgcacaaggcggaaggcgagaaatgtcagcgctgctggcattacactaccgacgtcggacagaatcctgagcatgctgaggtctgtggtcgttgttacactaacgtagccggtgacggcgaacagcgtgaatttgcctgatgcgtaaacctattttatcaaccggattgcgctggctgtggctggtgctggtggtgattgttgtcgacttcgccagtaagcagtgggtgatgaacaacatgatgctgcatgaaacccagccactgatgccctacctgaacctgttctacgcgcacaactacggcgcggcgttcagtttcctggcggacaaaggcggctggcagcgctggttctttgccggtattgcgctggctatcgtgatctcactggtcgtgatgatgtatcgtaatcatgccagtcagaagatcgctaacatcgcgtatgccctgatcatcggcggcgcgataggcaatctgtttgatcgctcataccatggctttgtggtcgattttatcgatttctatgtcggtaactggcacttcgctacatttaatatcgctgactgcggcatctgtatcggtgctgcattggtggtgctggagggctttttcagcccgaacggcaaacaggctaaacagaaagggtaagtgatgactgagtccgtacagcgcgaaagcgcggtgttggtgcattttacgctgaagctggaagatggctcgacggcggaatcgacccgtgcaaacggcaagcccgcgctgttccgtctcggtgatggcagcctctctgcggcacttgagcaggcactgctggggctgaaagcgggtgaaactaaacagtttaccctggaaccggacgacgcctttggcggcgtcagccctgacctgatccagtatttctcgcgtcgggactttatcgatgcgggtgagccggaagtgggagccatcatgctgttcagcggcatgggcggcagtgaaatgcctggcgtgatccgtgaaatctctggtgactctatcactgtggatttcaaccatccgctggcaggtcgtcgtattcagtttgatgtagaggtgctggaaatcgatcccgcactggaggccaacgatgcaaatcctgttagctaatccgcgcggcttctgcgctggcgttgatcgtgccatcagtattgttgagcgcgcgctggagatgtatggcgcgccaatctatgtccgtcacgaagtggtgcataaccgttacgtggtaaacagcctgcgtgagcgcggtgccatcttcattgaagagatcagtgaagtgccggataacgcgattctgatcttctctgcgcacggtgtttctcaggcggtgcgtgccgaagccaaagcgcgcaatctgactatgctgtttgacgccacctgtccgctggtgaccaaggtgcatatggaagtggctcgcgccagccgtaaaggcgttgaggcaatactgattggtcatgcgggtcatccggaagttgaaggcaccatggggcagtacaacaaccctaatggcggcatgtatctggtggagtcaccggaagatgtcttcagactgacagtgaaagacgaaaacaatctgagcttcatgacgcagaccacgctctctgtggacgacacctctgacatcattgatgctctgcgccagcgcttcccggcgattatcgggccgcgtaaagatgatatctgctacgccaccaccaaccgtcaggaagcggttcgtactctggctaaagatgcggaagtggtgctggtggtggggtcgaagaactcctctaactctaaccgtctggctgagctggctcagcgtgccggtaagctggcgaagctgatcgactctgcggatgatattcaggaagagtgggtaaaaggcgtggcctgcatcggcgtcaccgcaggcgcgtcagcgcccgatattctggtgcagcaggtgatccagcggctgcgtgaactgggcggcgaagcggcaattgagctgattggccgtgaagagaatattgtcttcgaagtgcccaaagagctgcgtgtcgaagtgcgtaacgtgcagtaactctgcgatattactaataaaaaggccgactctgttcggccttttttgttttttgaatctgacaaaaaaagtcgttatttgctgcggtgattgcttttactgataatcacgggcggctggcataaaattcttattatcacggattaatagtggcgtgactgttaactcatcgttaacctgatgacgctttggatgcatagttttgttttaggaatgaataaatatgaacacaatccgcattgctattgtgggcgcgccgggccgtatgggccgtaatctgattcaggcgacgcagcaggcagaaggcgcagaaactgggtgcggcactggctcgcccgggctcatcgctgaccggcagcgacgctggtgaattagcgggcatcggaaaaaatggcatcatcatcgctgacgatttacgcgcggtgattaacgattttgatgtgctggtcgacttcacccgcccggaaggcacgctggagtatatggcgatctgccgtaagcagggcaaagcgatggtgatcggcactaccggttttgatgaagcaggcaaagcggccattcgtgccgcggcagaagatatccccattgtgttcgccgctaacttcagcgtgggggttaacctggtgctgaagctgctggagaaggctgccaaagtgatgggggagtacgcagatattgagatcgttgaagcgcaccaccgccataaagtggatgcgccctccggaaccgcgctggcgatgggtgaggcgattgccgatgcgatgcagtggaaactggatgagcatgcggtctatacgcgtgagggccacaccggcgaacgccagccgcagagcatcggttttgcaacagtacgcgcgggtgacatcgtcggtgagcatactgcgatgtttgcagatatcggcgagcgcgtagagataacccacaaggcttcaagccgtatgacctttgcaaatggcgcggttaagtccgctttatggttgaaagataagaaatctggcctgtttgacatgcgtgatgtgctggatttgtcgatgttgtaagtgttgtgaaccatcgtgatgtggttgtttcaatcgataatcgcttgattgaaaaggggcaatgttttcattgcccttaattttatctgaaatatgccttccagatataaatttacctctgacttctgttttttcctgttttcttcatttatttgctctgccggatgctatttttgaccatttggtcaaaaataaaggccgcgctgcatctattttgcttttatgctgcctggcaaacgattattccgccgagttttcctctctttttgctgcttatgcccgttattttcctcagaaggcagataagggtgaaaaaatcccgccgcagggtagacaatggccagggcgatcattagaatgcgcgcaatttgccaaaaatcgacaattcaggcggtttttgcattgattcaggcggctattttgaattaatatgcagatattgtgactgtttattccctggaggatgttttgattaagtcagcgctcttggttctggaagacggaacccaattccacggtcgggccatcggggcaacagggtcggcagtgggagaagtcgttttcaatacctcaatgaccggttatcaagaaatcctcactgatccttcctattcccgccaaatcgttactctcacttatccccatatcggtaatgtcggaaccaatgccgccgacgaagaatccagccagattcatgcgcagggcctggttatccgtgacctgccgctgattgccagcaacttccgtagtgaagagggcttatccgcctacctgcagcgcaacaacatcgtggcgattgccgatatcgatacccgcaagctgacgcgcttgctgcgtgagaaaggtgcacaaaacggctgcatcattgcgggcgataatccggatgccgcgctggcgctgcaaaaagctcaggcgttcccgggactgaaagggatggatttggcgaaagaggtctgcaccactgagacctacagctggcagcagggcagctggacgctggagggagggctgccagagcaggccgacgctgaatcactgccttaccatgtggtggcttacgattacggtgccaagcgcaacattctgcggatgctggtcgatcgcggctgtcgtctgaccgtcgtttccggcacagacgcctgccgaagaagtactgaagcttaatccggatggcatcttcctctctaacggtcctggcgacccggagccgtgcgactacgccatcagcgcgattcaggccttcctgaaaacagagatcccggtgttcgggatctgtctgggtcatcagctgctggcgctggccagcggggctaagaccgtgaagatgaagctgggccaccacggcggcaaccatccggtgaaagatctcgataacaatcgcgtgatgatcaccgcgcagaaccacggttttgcggtcgatgagaacaatcttcccgctaacctgcgtgttacacacatttcgttgttcgataaaaccgtgcagggcattcaccgcaccgacaagcccgcattcagcttccagggacacccggaagccagcccgggcccaggcgatgctgcgccgctgttcgaccactttattgaattgattgacgcattccgtctgcaagcgaagtaatcaggagctaattcatgccaaaacgtacagacctaaaatccatcctgattcttggtgccggtccgattgtgatcggccaggcctgcgaatttgactattccggtgcgcaggcgtgtaaagcgctgcgtgaagagggttaccgcgtcattctggtgaactccaacccggcgacgatcatgaccgacccggaaatggctgatgcgacttacattgagccgattcactgggaagtggtgcgcaaaatcatcgaaaaagagcgcccggacgcggtactgccgaccatgggcggtcagacagcgctgaactgtgcgctggagctggaacgtcatggcgtgctggaagagtttggcgtcaccatgatcggcgcaacggctgatgcgatcgacaaagcagaagatcgtcgtcgtttcgacgtggcgatgaaaagcatcggtctggataccgcgcgctccggcattgcgcacaccatggaagaagcgctggccgtggctgaagatgtcggtttcccctgcattatccgtccctcatttactatgggcggaaccggtggcggcatcgcctacaaccgcgaagagtttgaagagatttgcgaacgcggtctggacctctcaccgaccaatgagctgctgattgatgagtcgctgattggctggaaagagtatgagatggaagtggtgcgcgataaaaacgacaactgcatcatcgtctgctcaattgaaaacttcgatgcgatggggatccacaccggtgactccatcacggtggcacctgcccagacgctgaccgacaaagagtatcagatcatgcgtaacgcctcgctggcggtactgcgtgagatcggtgttgaaaccggtggctccaacgtgcagttctcggttaacccgaaagatggccgactgattgtcattgagatgaacccgcgcgtgtcacgctcctcggcgctggcctccaaagcgaccggtttcccgattgctaaagtggcggccaaactggcggtcggctataccctcgacgagctgatgaatgatatcaccggcggtttaacgccagcctcgttcgagccttccatcgactacgttgtcaccaagatcccgcgtttcaacttcgaaaaatttgccggtgcaaacgatcgcctgaccacgcagatgaagtcggtcggggaagtgatggcaattggtcgtactttccaggaatccatgcagaaagcgctgcgcggcctggaagtaggcgctaacggcttcgacccgaaagtccacctcgacgacccggaagcattaacccgcatccgccgtgagctgaaagatgccggttcagaccgcatctggtacatcgcggacgctttccgtgccggcatgtcagtggatggcgtgttcaacctgaccaatattgaccgctggttcctggtgcagatcgaagagctggtgcggctggaagagcaggttgcccgtgaaggggttaatagcctggatgagacattcctgcgcgccctgaagcgtaaaggctttgctgatgcacggctggcaacactggcgggtgtggcagagagcgaaatccgcaagctgcgtcagcagtttaacctgcacccggtttacaagcgcgtggatacctgcgccgcagagttcgcgacagacaccgcctacatgtactccacctatgaggaggagtgcgaagccaatccaagtccggatcgcgaaaaaatcatgattctgggcggtgggccaaaccgtatcggtcagggtatcgaattcgactattgctgcgttcacgccgccctggcgctgcgtgaagatggttaccagaccattatggtcaactgtaacccggaaacagtctcgaccgattacgacacctctgatcgcctctacttcgagccggtcacgctggaagatgtgctggagattgtgcgcattgagcagccaaaaggtgtgattgtgcagtatggcggtcagactccgctgaaactggcgcgtgcactggaagccgcaggcgtaccggtcatcggcaccagcccggattccatcgaccgtgctgaagaccgtgaacgtttccagcaggcggttgatcgcctgaacctgaagcaacccgccaacgccacggtggccacactggagcaggcggttgagaaagccgcgggcctgggttatccgctggtggtgcgtccttcttatgttctgggtggccgtgccatggagatcgtctacgacgagatcgacctcaagcgctacttccagacggcggtctcggtttccaacgatgcaccggtgctgctggatcgcttcctggatgatgcggtcgaagtggatgttgatgcgatttgcgacggtgagcgggtgctgattggcggcatcatggaacacatcgagcaggctggcgttcactccggtgactccgcctgttcactgccggcctacaccctgagtcaggagattcagaatgtgatgcgccagcaggttgagaagctggcgtttgagctgaatgttcgtggcctgatgaacgtccagttcgcggtgaaagacaacgaagtctacctgatcgaagttaaccctcgtgcggcgcgtaccgtgccgttcgtctctaaagcgaccggtgtcccgctggcgaaagttgccgcgcgcgtgatggcaggcaaaacgctggcagagcagggcgtcactgaagaggtgattccgccttactactctgtcaaagaagtggtgctgccgtttaacaagttccagggcgttgacccgattctggggccagaaatgcgctctaccggtgaagtcatgggcgtgggccgcaccttcgctgaggcgttttccaaagcgatgctgggcgcacagagcaacatgaagaagtcgggccgtgcgctgctgtcggtgcgtgaaggcgacaagaaacgtattgtcgacctggccgctaagctgcagaagtttggtttcgaactggatgcgactcacggcacggcggttgtgctgggcgaagcgggcatcaacccgcgcctggtgaacaaggtgcatgaagggcgtccgcacattcaggaccgtctgaagaacggcgagtatagctacatcgtcaataccacggcgggtcgtcaggcgattgaagattcgaaactgattcgccgcagtgccctgcagtataaagtgcactacgacaccacgctgaacggcggcttcgccaccgcgatggcgctgaatgcagacccgacggaacaggttatctccgttcaggagatgcatgcccagatcaaggcgatgtaaggcgatgtaatgtgaaaaacggctcctgcgggagccgttttttttggccaaaatctggcccggtcagctgtgagatcgagcctgcgaagggaacacggtcagatcggaaagtcgcttaagccaatccctggccgctcggcccgcgccgtccatggcgcgggacgctttcctcttctgcccgtgttccctgcgcgttgagcctatgcattgtggaaaaaaaacctgaattgaatttgtcagctgtctgaacgactcctgcgggagccgtttttttttgaccattttattggcgataatccgaaaacagggtccagaaaaagcaaagagtttgcgttaaagtcactgatttggcttaattttttagctataggtgcgaataaggtcggttcgcacaaatttataatataaacacttcctgtgcggatttttcgtcagtactatgcctgccgctcatcactggagcgtatcaggacataaataaaaaatgaaaatgcgtactttttctctgagtgcagtggctgcactgatggcaattcttcctttcgccagccaggcggaaattaccctgttaaaacaggatccgcaggcaggcgatccgcttagccgtcttaactttacttttggcggcagcattcgtgctcagttcaatcatcagaccggcgtggatgacaaatcctacaagcgcgacggttttgacggcggcacccgtttccgtttcggcgctgactactacctgtttgatgacgtcagctggatcagctactacgagctgggcgttaacgtcccggcggtcttcagctgggatcgtcactatgcggacggtgccaataacaccacgcgtcgtcagctctacaccggtctgaaaagcaaaacctggggccagcttaccttcggtcagcagaacagcgtctattacgataccgtgggcgccaagaccgatatctgggattacgacatggtcggccaggctccgggtaacgggatcaacggcgactacgacggatcttaccgctcacgcaaacagctgaagtataaaaacagcttcggcgatgcggatctttacgcctcttatctgttcgaagataacgagtatctgccaggcaacggcctgcgctataagcgcaaaggcggcggctcgctgggtgtggactaccacatcacggacgatctgagctggggcacggcgtggaaactacacccgcgcggcgatgcgtaacccgaacaacggcgacagccgcgattacgatcagaacatctacggcaccgcgctgagctggactccaggtaactggacgttgtcagccggcggtggctggtatgagaacttcatgaccaccaaacgcaaagatgtgcatgactactttgccggcgacgcgtggggcattgaatatttcgccggttacaagattccggtggggcagtatggtctgaaagcggtacagccgtatgtcatgggcgatcgcattgagtatgcgacaggccgtaattatcagcgcatcgacaacggtctgggtgtggtgctgttcctcgactacggtttccgtgtcgattacgaacatgtgtttacctccagcaccgataacctgggtgatatgaatctggtgcgtctgcgctacgacttctgataaccctgacggctcctccgggagccgttttcttttgcgcacgacttttgtgccagcctgaggccgatcgctggcgagctgcggcaaactgacgcgattaggcggtgaaaaacgctgcacaggccgtgaaaaacgacgtcatgaaaagctttacgcaattagacctttccccctatcgacgaaagtttcacctttacgtatcatggcgccaatttttttcagtgagtagttaacatgattagtcttatcgcggcattagcagcagatcgcattattggaatggagaacgccatgccgtgggacctgcctgcagatctggcgtggttcaagcgccatacgctgaagaaaccggtaattatgggccgactgacctttgaatctattggccgtccgttacctggccgactgaatatcgtggtcagcagccagccgggcaccaccgaaggcgttacctgggtcacttcgctggatgaggcgttacaggcagccggtgacgctgaagagatcatggtgattggcggtggccgcgtctatgagcagatgctgaagcgtgccgatcgtctctatctgacgcacattgatgcggaagtcgaaggtgatacgcagtttcccggattatgagccggatgagtggcagtcaacgttcagcgaattccacgacgctgacgagcaaaattcccacagctactgctttgagatccttgaccgtcgtcgctaatcccacccctgccgggctgtaacctggctgtcatctttattcattagcattgcttcttttctgggatcgacacaaaggaagcaatcactaatgaaaatcgaactctccgcattaagcactgaccgcctgcctgatccactgcgtcgtaaattccttgccggttccggtgctatcggcctgaccggctttctcagcggcggcctgacgctctcgggcagcgcactggcgcaggagaagcctgcgggcagtccgctgctgggctttcaggcgattgccgcgtccacggccgatgagattgtggtggcccccggctatcgcgccgacgtgttgatctcctggggtgatccactggtgaatggcgcagccgcgtttgatccgcagggcaacaacagcgccgaagatcaggaaaagcagttcggtgacaacaacgacggtatgagcttcttcgcgattaatgaccatcgcggcgtgatggcgattaacaatgaatatgtgaatgagccgacgctgttcgcccacggcggcagtaaagcgaccagcctggaagatgtcaaaaagtcgcaggcggcgcacggtatctccatcgttgaagtcaaacggggtgaggacaatcgctggcaggtggtacgtccttctgactataaccgccgcattaccgccaataccccgatgcgcttctccggtccggctgcgggggataaagcgctgcagactgccgccgatccgcagggaatgaatgtcctgggcacctttggtaactgcgccaacggcaaaacgccgtggggcacctatctcacctgtgaagagaactacgacacctactttggcacccatcaggcggactttacgccgacgccacagcagaagcgctataccctgaatgccgctgagccggagcgcaactgggccgactttgatccccgcttcgatatcgctaagaatcccaacgaattcaaccgtcacggctggattgtcgaaatcgatcctttcgatcctcactccgtgccggtaaagcggaccgcgctgggccgcttcaagcacgagaatgccgctgtgacggtcgcgaaaaccggccagctggtggtttatatgggcgacgacgagcgcggcgagtatatctataaatttgtctcagatgacaaggtcactccggatgatgctaaagccaatcacggactgcttgataagggcacgctctatgtggcgcagtttcaacggcgatgcgcagggcacaccgcttaaaggcaccgggcgctggctggcgctgaagtggggcgaaaatggactcactgctgaaaagggattcaatagccaggcagatgttttgatcaatgcgcgtgccgcagcagatgtggtcaacgcaacgcgaatggaccggccggagtggattgcggttaacccgcatgacggccgtgcctactgcactctgaccaacaacaacaagcgcggaaatgaaggcatgccggtcaatgcagcgaatccgcggccaaaaaatatctacggtcagattattcgctgggatgagaaaggcgatgctaccgcgcagacgtttgagtgggatatctatgcgctgtgtggcaacccgatagcgcatcctgaggggatctatcgtggcacaccgaacatcaccgcggagaatacctttaacagtccggatgggctggggtttgatgcgcaggggcggttatggatcctgaccgacggcaaatacagcaacaaagaggattatcaggggcaggggaataatcagatgctggtgggtgatcctgatagtggcgagatccgccggtttatggtcggtccaaaatcgtgcgagctgaccggtattaccttcacgcccgattacaaaacgctgttcgtgaatgtgcagcatcccggcgaagagggtgactcgcatttcccagacaacagtccgcgtccgcggtcgtcggtgattatgatcacccgtgaagatggcggcattatcggcgcataaaacaggatgctggcctgatggccagcatcgccgttatagcgcgggcggtgccagactgtcgctggaggccagggctttttcgcgattagagggctgcaccacatagcgttgtgtctcccagtgcagcagggtcagcgttccgccccagcagcagccggtatccagcccgataatgccctctggcgtgcctttgccttccagcgaggcccagtgaccaaagacgatggtgtagtcacgtgcgaccggcccctcaatgttaaaccagggtttcagcggcggaagcgccgattccggggcatctttgcagatcatgtccagctggccgttggggaagcagtagcgcatgcgggtgagggcgttggtgctgaagcgcagacgcgccaggccggtcagatcctcactccagttgttcggcatgtcgccatacatggcatccaggaacagcggataactgtcgctggcgagaaccgcttcgacttcacgcgcgcactttttcgcggtctcaatatcccattgcggcgtgataccggcgtgtcccatcaccagctttttctcttcatcaacctgtaacagcggctgacgacgcagccagttgatcagctcatccgcatcatccgcttccagcaacggggtcaggcgatctttaggcttgttacggctgatgccggcgtagaccgccagcagatgcaaatcgtgattgcccagcaccagacgcaccgcgtcgcccagcgattttacgtagcgtaatacttccagtgagccaggaccgcgcgccactaagtcgccggtcagccacagggtatcctgctcaggattgaagtcgacctgttgcagcaatgcacgtaattcatcgtagcaaccgtgaacgtcgccaatcaggtatgtgctcataacgttttatccatcaggaaggtgcccgacttaacgggcaaaaagcgtgtgaatcaatgaatgtgggtctgaatggcgaggcggaacaccgggatctctacgtgaaaagtgtcgccctgttcgtcgaccatcacatagtgcccctgcatggtgcccatcggtgtttcgatcacggcaccgctggtatactgaaattcattgcctggcgcgataagcggctgttcaccgaccacgccttcaccctgaacttccgtttcgcggccgttaccgttggtaatcaaccagtagcgtcccagcagttgcactgaggaacggcccagattgcgtatcgtaatggtataggcgaagacgtagcgatcatcatccggtgaggattgtgaggcgacgtactggctttgcacatggacggagacgcgggccgtttcactcatgacttactcctgcgattttccctgatgattcgccagccagttcgccagctgacaatattgcgccaccgagacgttctcggcacgcagggttggatctatggataactcttccagcgcaccggcggccaccatgtggctcaggctgttgcgcagcgttttacgacgctggccgaacgcttcagtggtaatgcggctcaggatacgcacatcgctgaccggatacggcggctcggcatacggcaccagacgcaccacggcagagtccactttcggtggtggcgtgaaagagtgcggaggcacttccagcaccggaatgatctggcagtagtactgcgccatcaccgtcagacgaccgtaggtcttgttacccggaccggcaaccagacgattaaccacctctttctgcagcatgaagtgcatatctttgatcgaaccagtatagctgaaaaggtggaacatcagcggggtcgaaatattgtacggcaggttaccgaatacccgcagcggctggcctctctcctgcgccagtgcggcgaagtcgaaggtcatggcatcctgctggaagatagtcagtttcgggccaaggaacggatgcgtttccagacgcgcagcgagatcgcggtccagctctatcaccgttaatttatcgaggcgttcgcctactggctcggttaaggcacccaggcctgggccgatctccaccagcgcttcgtcgcgctgaggatggatggcagagacaatgctgtcgataatgtactgatcgttcaggaagttctgcccgaaacgtttacgggcgtagtgcccctgatggacgcgattattcattactgctcttgatcatagtgatggcgaggttaagcgccgtgatgaagctgcccggttcagcctgacccaggccagcgagttcaagcgcggtgccgtggtcaactgaagtccggataaagggcaggcccagggtgatatttaccgcccggccaaacccctgaaatttgagtaccggcaggccctggtcgtgatacatcgccagcaccgcatcggcgtattgcagatatttgggctggaaaagggtatccgcaggcagcgggccggtcagattaatgccctgctgacgcagttcattgagtgccggcgtgatggtctcgatctcttcccgacccatgtgaccgctttcgccggcatgagggttaagaccacagacgtaaatatgcggctcggcaatcgcaaacttctgctgcagatcacgatgcagaatcgtaatcacttcatgcagacattcacggtttaccgcagcgggcacatctttcagcggcagatgggtggtggccagtgcgactcgtagctcttctgtcgccagcatcatgaccacccgatggccgcctgcgcgatcggcgaagaattcggtatggccggtaaaggcgatgccggcatcgttaatcacgcctttatgcaccgggccggtaatcagggcagcgaattcaccgtcgagacaaccgtcgcaggcgcgcgtcagcgtggccagcacatagtcgctgttggcgacgcaaagctcgccgggtgtgaccggcgctgccgtttcaattggcaggatagtcagtgtacccgcctgctgtggctcggctgccacgccaggctggtagggccgcagggtcagcggcagaccgagttgcgccgcacgctgctgcaacagggcaggcgaggcgcagaccaccagttcaaccggccacgactgctgggccagctgaacggtaagatcaggaccaatcccggcaggttcgccgggcgtgatcaccacacgggcattactgcgcattgccatccagaatcttcacgtaggcactggcacgttgttcctgcatccaggtctgcgcttcttccgcgaacttacggttaaacagcatacggtaagcacgctctttctgggccgcatcggttttatccacctgacgggtatccagcaactgaatcagatgccagccgaaagaggagtgaaccggctggctggtctggcctttctgcaggcgcagcagcgcgtcacggaacgccgggtcaaagacttccggagaggtccagccgaggtcgccgccctggttcgccgaacccggatcgtcagaatactgtttagccgccgccgcaaaggtggttttgccactgcggatatcgttagcaatctgctccagctgtgcgcgtgcctgatcgtctgtcaggatcggcgatggcttcagcagaatgtgacgcgaatggacttcggtgaccgagacatttttgctctcgccacgcaggtcgttcactttcaggatgtggaagcccacaccagagcgcaccggcccgacgatatcgccttttttggcgctcgagagtgcctgagcaaacagggtcggtaactcttcgattttaccccagcccatgttgccgcctttcagcgcctgggagtcggcagagtaggtcacggccatcttgccgaagtcagcgccatttttcagttcgccaaccagctgtttcgccagcgtttcctgctcatcaacctgctgttgcgtcgggttttccggcagcggcagcagaatatgactgacgttcagttcggtaccctggctgttctgagagccgatctgcgtagcaagcgtatccacttcctgcggcagaatcgtgacacgacgacgcacttcgttgttgcgcacttcggcgatagtcatctctttgcggatctgagaacgatacacgctgtagttcatgccgtcataagccagacggctacgcagctgatcaaggctcatcttgttctgcgcagcgatgttctgaatagcctggtccagctgctcgtcgctgatctgaattcccgctttatcacccatctgcagaatgatgttgtccatgatctgacgttccagaatctgatggcgcaacgttttatcatccggcaactgctgaccagcctgctgggcctgagatttaacggtgctcatcatgccatccacgtcactctcaagaaccacgccgttattgaccacggctgcaactttatcaacgacttgtggtgctgcgaacgcggtgttggcactgattgccacaccaagaatcagcattctccagttcttcatactttatccattgttggttccgcactgcgggattgcctgtcaaacatcacaacatcagaaagcaggctggtaagggataatgccctgacgcagcatatcgttggtgcctaagccatagtttcggactcagaccacgcagctcaatgttgaatgagatttggttgtcatacttactgtcgttgttttcccaaccgttaattttgcgttcataaccgacccggatagcgtaacagcatgagctgtattgcaggccaaccagttgtgaagccggacgcgtgttgcgggtatcgtagtagtaagcgcctaccacagaccatgcgtcggcaatcggccagctggccgtagtacctacctgtgaaatcccatttttgtagataggattcgtgaccaggctgctatcgttcagcgcggtcgcaacatactccgggctgctgtaacggtagctcagctgcaccatgcggtcggcatcacgacggtattccagtacggtattgccctgggagacgttgtcgagtttggtgtcatattgcagcccaccacggacgccccagcgatcgctgattttccagtatgtatcgccagcccagatcaggctgccggtatcatcttctttactggtttgattcacaccagtacgagaaggggtaaacgagtagatttgacctacagaaacgttaaaacgttcaaccagatcgttatcataaatacgcgaggtgacgccggtagccacttcattggcggaagcgatgcgatccaggccgctataagtacgatcgcggaacagaccggtgtagtcggtttgcagcagcgttgagtcgtacggatagatattgctctgattacgatacgggatataaaggtactgcacgcgcggttccagcgtctgggtgtaacccaccgccgagttcatatcgcggtcaaacaccagacggccatcaactttaaattgcggcagggtgcggttgacagactcatccagatcgccacttttgccgttattgttcgcaaagttattgttgtaataatcaacgttagtttgctggtaatgggtcgccaggaacttcgcttcggtatccaggctggcccagccgtttgacagcggcaggttcagcgttggctcaacatgtaaacgggtcgcttcgggatagcggctgctgacattggtgaacttcaccgcctgggcataaacccggccatcaaacgggccgatatcgttctgatagagattgacgtccagctgcggcatggcgcggtagacgttattgctggtggtatcgccgaacacctggaaatctttggtggagagcgtggcgtcccagttggtgtccgcatagccgatgctgaatttctgcgtggcgtagttgtcggtcgagctgtagtacttcgagtcgagatcgttgaagtagtacttatcactgaccttggtgtagtccgcgctgaaacgccagttctggtcatagacaccggcatgacgccagtagaacagccagcgatcggagctgtcattttcggcaatgccgcgcaccgctttgtcgttatcgtactgtttgtccgagccgaggtagtcgaattcaaccagacctgcacccagcgtggtcagataacggaattcgttctggaaactgcatgccgcgcttactcatgtagtgcggcgtgatggtcgcatcggcctgcggcgcgatgttccagtaatagggcagcatgaactcaaagccgttgttgctgccatattttgcattcgggatcaggaaaccggagcggcgacgatcgccaatcggtaattgcagataggggctgtagaacaccggaacagatccgattttgaagcgggcattccagatctccgccacttcctcttcgcgatcctggattacctctgaacccaccacgctccagctgttggagccgggcagacaggaggtaaaggtgccgttttccagaatggtgtagcggttatcgccgcgcagcttcatctgatctgcgacgccgcgtccctgacgatctaccatctggtactgaccattccagacgttggtatctttgctgttgaggtttgaccaggctttcggacctttcaggatgacctgattgtcatcgtagtgcacattacccagcgcatcgacggtacgtacgggcgcggtctggcctttctgctgacgctgatgaagctggacttcatccgcctgcatacggctgttgccctgctcaatattcacattaccggtgaataccgcatcgttgggatagttccctttggcggcgtcggagtgaatggtgacgggcatctgattcgtatcgccattcaccagcgggcggttataactcggcacgcctaacatacactgcgacatcaaatcgtcggcaaaggcttgctggctaatggctgcgccgatcagtgtggccagcagggtaggtatatgttttttcatacgcggtatcgagaattccatgaaaactggcatcatgccgacaatcgggtcagagactaacttactgcccggcgttgcgccagtgttaatcctggtcagtcagcgttgccgttaggcgctgagataaatgacaggtatgataatgcaattttcagccgcaagcatggcgaattgaggagtttatgcgctactggggaaaagttgtgggtctggcggtgggattactttccggcgcaggcttttggggtattgtgatcggtttgatcattggccatatgattgacaaagtacgcggcgcgcaaggcaaggcttacttctcaaataatcagacccgacagacgctgtttttcagcaccacctttcaggtgatgggccatctgaccaagtcaaaagggcgcgtcacggaagcggatattcagattgcttcgctgttaatggagcggatgcagctgcacggtgactctcgcacggctgcccagcgcgcgtttccgcgaaggcaagcaggcggattatccgttacgcagcaaactgcgtgaactgcgcagcgcctgttttggccggtttgatctgattcggatgttcctggagatccagattcaggccgcctttgccgacggttcactgcatcccaatgagcgacaggtgctctatgtgattgccgaagagctgggcatttcacgcggtcagttcgatcagttcctgcgcatgatggaaggtggccagcagtttggcggtggtcagcgcagttcaggcggttttcagcaggcgcaacgcgggccaacgctggaagatgcctgtagcgtgctgggtgtgaagagtagcgatgacgccaccaccatcaaacgcgcctaccgcaaactcatgagcgaacatcatcctgacaagctggtagcgaaagggttaccgccagagatgatggagatggcgaagcagaaagcgcaggaaattcaggcggcgtacgatctgattcgcaaagagaaaggctttaagtaaacaccatgttccgtggccgcttctgcaacagaggaggccacggtgacaggcgagcagtaaaccttaaaaatcggcgggctgacgaaacgtcatggcgttaccaaatgccggatgggtaatggtcagtgactccgcatgcagcagtaaacggggcgccatcgctttggcctccggatgcgcatagaagttatcccccagaatcggatggcccagcgccagcatatgcacccgcagctggtgtgagcggccggtaatcggtttcagcgaaacacgcgcactgttatccgcacgatattccagcacctgatattccgtctgcgcggctttgccggtctcgaagcagaccatctgcttcggacgatttggccagtcgcaaatcagcggcaggtcaaccaatccctcttccttcgccggatgaccccagatgcaggccacgtaagtcttggaaggctcccgctcacggaactgtcgtttcagctcgcgctcagcagccttagtcagcgccacgaccatcacgccgctggtcgccatatccagtcggtggacagattcagcctgcgggaaatcacgctgaacccgcgtcatcacgctatctttatgttcgtccagccgaccgggtaccgagagcagaccgctgggtttgttcaccaccatgatgtgcgcatcctgataaaggatgtgcagccagggttcacgcggtggattgtaaggttccatggggctttccaaaaataaggggccatgcggcccctgagcttactggtgtgtcaccacaatcaggcgcagtgcgtcgagacgccagttggcctgatcgagactttccagcacctgttcacggttgctttccagcgcctcgacttcatcgtcacggatgttcggattcaccgctttcagcgcgttgagacgggagagtttctgcgcccagcttctcgttcgcttcggcacgcgctgcatcaatcaccgcacgcgcttcgctgaccacactctcttcgccctgggtcagaatcgcatgcacatcctgctgcaccgcattcaccagtttactggcggtatgacggttaaccgcattcagctgacggttaaagctttcgaactccactttgtccgccaggttagtgcctttagtatccatcagcagacggattggcgttggcggcaggaagcgggtcagttgcagatgcttcggtgcctgcgcttcaaccacatagatcagctcgaccagcagcgtccccaccggcagcgccttgttcttcagcagtgacagtgcgctgctgccggtatcgcccgacagaatcagatccagaccgttgcggatcagcggatgttcccaggtaatgaactgggtatcttcgcgtgacagcgcctgatcgcggttgaaggtaatggtgcagccatcttccggcaggccagggaaatcgggcaccagcatgtggtcggaaggggtcagcacgatcaggttatcgctgcgatcttcctgattgataccaacgatatcaaacaggttgagcgcgaagttcaccagaccggtgtcgttatcctgctcgctgatggcattggccagtagctgagccgattcgccgccgttggagttcagctccagcaggcgatcgcgaccctgttccagctgcagtttcagcgcgtcatgctgtttacggcagtcggtgataaacgcatcaaaaccttcgctgttttccggcgcggccagatagccgatcagttgcgaatggacgctgtcatagattgtccggccggtcgggcaggtatgttcaaacgcgtccagcccttcgtgataccagcgcagcagtaccgcctgtgcggtctgctccagccacggcaccagaatctgaatgtcgtgcgcctggccaatacgatccagacgaccgatacgctgctccagcaggtccgggttaaacggcaggtcgaacatcaccagacggctggcaaactggaagttacggccttcagaaccgatctcggagcacaacagcacctgcgcgccattctcttctgaggcgaaccaggcggcagcacggtcacgttcaatgatcgacagaccttcgtggaacaccgctgcgcggataccttcgcgttcacgcagtacctgctccagctgcagcgcggtggccgctttggcgcagatcaccagcactttctctttgcggttggtggtgagatagcccatcagccattccacgcgcggatcgaagttccaccaggtgccgctgtcgccttcaaattcctgataaatctgttccggatagagcaggtcacgcgcccgctcttctgcacttttgcgcgcgcccataatgccggagactttaatcgccgtctgatactgggcaggcagcggcaggcggatctggtgcagttcgcgtttcgggaagcctttaaccccgttacgggtgttacggaacagcacgcggctggtgccgtggcggtccatcagcatggagatcagctcctgacgcgcctccagcttgccgtcacggtcgctgttggcgacctgcagcagtggctcaatatcctgctcgccgaccagatcgttgatccggttcatctcctcctgggagatcgctttatcggccagcagcgcggtgacggcatcggcaatcggacggaaatgctgctgctcttcaacaaaggcggcaaagtcatggaaacgattagggtcgagcaggcgcagacgggcgaagtgactctccatgcccaactgctcaggtgttgcagtcagcaacagaaccccggcggttttctcagccagctgttcgataacctgatattcacggctgggctcgccttctgaccaggccagatggtgcgcttcatcgaccaccagcagatcccattcggcatcggccagcatctcaagacgctgcttgttacggcgcacgaagtccagtgagcagataatcagctgctctgtttcaaacgggttatcgctgtcgtgctgcgcttcggtatagcggtcgtcatcaaacagcgcaaagcgcaggttaaagcggcgcagcatctcgaccagccactgatgctgtaaagtttcaggtaccacgatcagcacccggtcggcacggccagccagcagctgttgctgaatgatcatcccggcttcaatggttttacccaggccaacttcatcggccagcaggacgcgcggcgcatggcgacggccgacatcgtgggcgatatgcagctggtgagggatcaggttggtgcgcatgccgcgtaagccgctgattggcaggcgatattgctcactctggtatttacgggcgcggaagcgcagggcaaaacgatccatccggtcgagctggccggcaaacaggcgatcctgcggcttactgaacaccagcttgctgtcgagcatgacttcgcgcagcatcacttcgctctcttcggtatccagacgggtaccgatataggtcatcaggtcattttcgttgcgtacttcatcgacgcgcatctgccagccttcgtggctggtgatggtatcacccggattaaagatgacgcgggtaaccggcgaatcgttgcgggcgtagaggcggttttcccccgtggccggaaacagcagggtgatcatgcgggtatcgatcgccaccacggtgcccagtcccagttcactttccgtatcactaatccagcgctgacctaatgtaaaaaccatatattttttgctcgaattttaacgtttttagaggtgttcccaaagctcaggcaatagcgttaccgccagacaacaaggcctggagcgtacttaagagcggtgagtttcaggaagggcgctatggtactggatggcaggacgttcgtcacctgtcaaaaaagccccagctgtccggtaataagtgtagcaaagtccccttcgacaaaaggcagaatcccctctgcgaccggctgaagttgcttcgtcacgtagtggtcatagtccagcggcgtgctgcgcgcctccagtggctcggggcctgcggtggcgatgacataacggatccggccaccattctggtactgcaagggccggtttaatttacgattgtgctcatcggccagcctggcggcgcgcacgtgcgggggcacgtttcgttcatattctttcagcggacgccgcagccgctttttgtagatcagctgatcgtcgagttcacccgccagcaactgcgccacggttgtacggatataatcctgccacggctgacggtggaagatacggtggtagagctgctgctggaacgcttttgccagcggcgtccagtctgttcgcaccgactccagccccttaaagaccatgcgctcaccggcggcgtcacgaatcagtccggcgtagcgtttcttgctgccctgttccgcgccgcgaatggtgggcatcagaaaacggcagaagtggttttcatactccagttccagtgtgctggtcagcccctgcgtctgctgcagatggtcgcgccaccaggcgttcactttctgcaccagctgctgaccaatcgcggcggcatcttcttcactgtgcgccgacttcagccagacaaaggtggagtcggtgtcgccatagatgacgtcgtagccttccgcctcaatcagcgtgcgggtctgctgcatgatggcgtgaccgcgcagcgtaatagaggaggcgagccgcggatcaaagaagcggcaggcgctggtgccgagcacgccgtaaaaggcgttcatgatgattttcagcgcctgggacagcggctgattattctgctttttcgccgcttcgcgacccagccagatctgttcaactattgcaggcaggcagtgggtatgccgcgaaaaacgcgcttcacggaaaccttcaatcgaatcggcatcatcaggatgggccagcccttccaccagacccaccgggtcaatcaggaaggtgcggataatcgacgggtagaggcttttgtaatccagcaccagcactgagtcatacaggccggggcgcgaatccatcacataaccgccaggactggcttccggggccacatcacccatgttcggggcgacaaacccggcgcgatgcatccgcggaatatagagatgaccaaaggccgctaccgaaccgccgtggcgatccaccgccagtccattgaccgccgcgcgttccagcagaaacggcataatcgccgttttgtgaaaaatgcgcgtcaccagttcgcagtctttcaggttgtagcgcgccagcgccggtttatcgttggcaaaacgccagttgatctcctccatacgctgccagggattatcaatcgctttcccttctcccagcagttgctgcgacacggactcgaggctgaatgagggaaaatcccagaacgctgatttcagcgcgtcaatgccatcgataatcaaccggccactggcctgagcgaaaaatacgccgggtttgaagccatgttcacgccactccagcgcggcctgctggcgtcccaggcgcagcggaatgccgtaacgatcggcatgcttttgcaatacccgcaggtcaaactgcacgacgttccagccaattaagacatccggatcatgctctgcaaaccactggttcagggcttcaagtaactgcggccggctgtcgagatagatcagctcgaaatccagcgtgctggcatcaccgttggccgggccgagcataaagacctggcgctgaccgcatccctccagcccgatgcagtaaagctcgccatgctgtgtggtttcaatgtccagcgagacccatttcagcggcgggcgatagtcgggatggggtttgagccgcgcattgaccacgctgtcaccgcgctgctcgccgtcaaaccagaccggcgcggtaataaaacgctccatcaggtagcgctccggcggacggatatcggcttcatagaccggaataccctcttcgcgcagccgtttttcaatgcgctgtagctggcggttctgctggcagtagaggccgaaaaccgggcgacgccgaaaatctttcagcgccagcgactgaatccgaaactgacgttcatctttcagtaattcgctgacctgcgcctgaaattcctcaggaataaacgcgacggactcctgcaccggcagcaccacgcgctgcgcgcccgcatcggtcgcgagccagaggataatttcggtgccatgcgggctgtcgcgccagtggcgggtgagcagaaaacctgcacggggcatattcagatgttctccagactcagcatttcaggatgagaaaaccgcttcagtataacatggatatttatacagttcccgccacccgcttttgtcaacattgtcctacaattcttgccttgacgctgtgtggctggctcaggacaatccagccttctgcttttacttaggatgattatggaagcctggattcaacaactgattacgcagtccctggagtgggcgctgtttgccgttgcgctggtgacgtttctggagtcgctggcgctggtcgggctgttgctgccaggtacggtgatgatggccagtctgggcgcgctggtcggcagtggcgaaacttggcctttatccggcctgggcggcgggctttgcgggctgcctgattggtgactgggtttcctacggcatcggctggaaatttcaggggccgctgcaccgctggaagtatctgcaaaagtataaaggcctgctggataaaaccgagcacgccctgcatcagcacagcatgtttacgattctggtcggacgctttgttggccccacgcgtccgctgatcccgctggcggccggtatgctggagctgccggtgcgtaaattcctgccgccaaacattatcggctgcattctctggccgccgctctatctgctgcccggtattctggcgggtgtggcgatcgatgtgcccaaagccgcgcagggcggcagctttaaatggctgttactcggcgcagcactgctgatctggctgggtgtctggttatgctggcgctggtggcgcagcggcaagagtcgcgactgggcatcggcctggctgccgcctgagcgcctgcgctgggcagggccgctggggctggtgattgccgtcgcggctttcgtcggtattcagttccatccgatgatgcccattttccgtcatctgctgtggcaggttttcttcgcctgaatcgcttaacgacgcgggatgccgagcacgtcggcctcccgcgtgtcgcccgacagtaactgtcgggtctcgccatcccagtaaacccggccatccacaatcaccacgctgcgcggcgcaatctgctgggcatcttccagactgtgcgacaccatcagcagcgtgatgctgcgcgcttcacacaccgaacgcaccagttgcagcatctctccacgcagcgcgggatccagcgcagaaaaaggctcatccagcagcagcaccggacggtcacgcagcagacagcgtgccagcgccacgcgctgtcgctgtccgcctgacagctcgcccggcagccgcgtcagcagatcgcctaatcccacctgatcggccagcgctgcaagctgctggcgctgtccggcgctcagcttcagtccggggtgcaatcccagcgccatgttctgctgcacgctgaggtgcggaaacaggttgttctcctgaaacagcatcgacacgggccgtctggccggcacgctgtgggtgtgctcctggccgtcaatcatcagggtgccctgtttcaccggcaggaaaccggcaatcaggctcagcagggtgcttttaccggccccgctggggccgaggatcgcgatgcgctcgccgcgggtggcgttgagactaaaacgcatcggcagatgctgataaaggtacgtgaggttattcagtgtcagcatggcggcctggtaatttttccatcagggtgaacagcaacaaacagagcagcagcagcagcagcgcggtcactgcaccgtcagcaccgcgataggcaccgatctgttgataaaggtagaacggcagggtgcggaaatcggcagtaccaaacagcgccaccacgccaaaatcaccgatcgacagcacgcaggcaaaggccagcgcctgggccagcggacgtttcagcgcccgcagttcaatcagccgcagccggttccagccatgaatatccagcgaatcacagagtctgccgtaacgctccgcgacgtcacgcatcgggtttctccagcactttcagcgcatagggaatggcgatcagcgcattggtgaagatcaccagcccgtccgccgacgccggcagaccaatagtggcgttaaacaacaggaaaaagccggtggcgagcacgatgcctggcatcgccagaatcagcatgccgctggtgtcgataagggttgccgccgccgggcgctgatgcaggcgcagctcgcgactgctccacagcagcatcatggtcagcaccacacagagcagaccggcgccggtggcgatgcgcagtgaggtaaacgtcgcctgccagagtgcaggctgcgccagcgcgccgcgcagtccgccgtgcagaccatcgatgatgaccgccgccagcgggggcagtagcaggatcagcgccagcaggatcagcagcgcatcaaccagctgcgccgcgcgcgaatcctgcggatcgcgccagccgttcagctggctggttccggcgggaatcgctttgctgaagcgctggctgagcagcaccagcgtcacgcagcagccaagctggatcagcgccagcagtgcagcgcgccccggatcgtagtcataactcagcgcctggaaaatcgccagctcgatggtcgtcgcctgcgggccgccgcccagcgagagcacggtggcaaagctggcgaaacagagcatgaagatcagcgcgccggtcggcagcagctgacgccgcagccatggccactccagaagacgaaaatggtgccagccgcgcaggtcgagctgtgccgccagctgacgctgttccgccggaatgctctccagcgcctgcagcatcaggcgggtcgccagcggcaggttaaagaagacgtgcgccagcaaaatgcccgacagaccgtagggagagaagtggtaatcaatccctgccagctggcacagctgcgccagccagccgacacgaccatagacggtgagcagaccaaataccgccaccagcaccggcagtaccagggtcatggcgcacagacgcagcagcagctgacggccagggaaacggcgtcgatagagcgcgcgcgccagcggcaccgctggcagcagcgacaacagcgcggagagcagcgcctgaccaaaagagaaggcgataacgtgatgcaggtaatcatcctgcagcacgctgcgccagtcattctctggcgcggcgctccagagtgcaccgaaggccagcagcgccacgctgattaacagcagcgtggcgagcgaaccggggataagccagcgcggcatcagcggctgacggcgcgttgccactggctgatccagcctgaacgctggctggcaacctcttccggcgagaactgcagggcggtggcgggcacagtgagcgcgctaaaaccggcaggcagcggcgtgtcgattaccgggtacatccagttaccggtcgggatagtgcgctggaagtcgggtgacaccataaacttcatgaattgctgtgccagcgccggctgtttgctgctggctaactgcgcggcaacttcaacctgcagatagtggccctctgcaaacggcgcggcggcatagttctcttttttctcttcgatgatgtggtaagccggtgaggtggtgtagcttagcaccagatcgccttcgcccttgaggaacaggccataggcttcactccagcctttggtcaccgtcacggttttctgcgccagcttttgccacgcctgcggtgcctgatcgccatagactttctgcatccacaacagcaggcctaagccgggggtgctggttcggggatcttcgtagatcacccgccacttctccgggctgtcgaccagctctttcaggctttttggcggattcttcagccgggttttgtcatagacaaacgcgaagtagccataatcaaacggcacgaaggtggtgttgtgccagccgccgggcagttttaatgtcgaggcatcgacctgactttcggcaaacagaccggttttctgcgccgcctgtaccagattgttatccagccccagtaccagatcggctttgctgtttttcccttccatgcgcacgcggttcagcagcgacacgccatcttccagcgtgacgaatttcagctcgcagttgcactgcgcctcgaaggcttttttaaccgccgggccagggccccagtcagcggagaaggagtcgtaggtgtagaccgtgagaaccggcttagccgccagaacgggggcggagagtaacagcagcaccggcagaactttgtttaacactttgcgctccttcaggagaataggggatgagtcgcaaaggatctgagcacagaggcctcccaaatccctacgtcggtattaaccgaatcaggttcgacgggtatctctcagctgcttgctggtggcaggcggcaccccgttgagaacgtcacattctagtcatttcagcgccggggcgaaagcctcacagcgcgggtggcgcgaaccaggcggatttaaaatcaaaccagcccagcgtattcatccgaacgccgcgcatgctgcgctgaccttcaagcagcagccagtggtgaaacagcggatgaagacccgcttcttcgactaactgtttactccattcggccagcggcagcgttttctcgcgccagcgggccgcatcgctgtgccagtcgatcggcagacagtgatgcagcaacgggatctcataaagctgcgcaaacagagaataattcagcggcagggtaaagttcacgctgccaagccagatatcactttccgcttcgccctgataccagctttcgtagctgatctcgcgggtctccagcgtgacgccatgctctgccagcagcggacgcagcgcgttagcgatgccttcatgctccacgtgctggctgtaccaggtcagcgtcaggtgggttaagccgggcggtttttccactggcgtcaggtcgcgccggtgatgccagcgcggcagcaggccatacgccggaaaccagtagcgctggtagccgacaccggcgtgattgagcagggcgataggattaaacaggtagctgacccagcgccggaccgcctcgttgcgtccctgttctgaacgctggtcgaacagcagatagtagcagccctcttcaaggcggctctcctcctgaatctcatcggctccgtcgccctgcaggcggacaccggcatagaccagctcatcgctgatgtcgggcagtacccagatagagacatcatcaatcagggcgcgaaaaccaaaatagtcatcaaacgcttcgatcttcagctgactctcctgattgcggatcacccggtaaggaccggtgccaaccggctggcgggcaaaatcgtgcagcgtcggccattcgcgcggcaggatcatcgcactgacgctgcccagcagccagggcaacccttcatcgggctggcttaagcggatatccagcgtccagggcgcgggcgagtcgatctgctcgatatgggaaaagagcggatgggggcgctgacgctcaagcgtggccagcacatcctccatctccagctctctgccgtgatgaaagcgaatcgccggacgcagaaaaaagcgccagtgaagcggggaagtctgctgccagtggtgcgcaatatcgggctcgatttccccgttttcctcatttatccgcgtcaggccgttgaaaatctgtcgcgcaatgtgggtttcggagcgccgcagcggcgaaccgggcagcagattgagcagcggacgatagtagagcacccgcaggatatgcttgccctgacggaaactgcgccccagatgtgcggcgatcatctgccgtacctgatttttatcgcccaccagctggaccagctgatcgatgcgatcctgctccagcaaatcctcggcacgttgctgctgcaaagccagtccggtatagcagaaggtaagctgtgaacgcttgccgcgcccggcttccgcctgccagatcagccagcccgcggcctgcatccggttgagcagattgcgcatatggcggcgcgagcagtgcagcaggtcagccagttcgctaagggtaatctcctgcgtttgcccctgacagctctgccacaggcgaatgaactgctgcttcagacgtgatgaggacataaaagaggaactcccggtgaaaagcgctctgtttttcttgccctattttaagagcaaactttgcgttatgggaagagcgggaggcattcagttctgaatggcgttcgaccctgacttcgctgttcagcggagtgcttttctgagtagggtgcatttacaccgccagcagatgatctctgctggcttttttcatgttgcgcggtatcgtctacccttctttttcccctctgtttgttctgtaagggatttcggtatgaaatcgctgttaacgcggcagcgccgcatcaatccggtttacctcgcttttatggtcgcctcgttcatgctgggcatcgcgggcgcactgcaggcgccgacgctcagcctgtttctgacgcgcgaggtgcaggcgcggcccttctgggtcggactgtttttcaccatcaatgcggtggccggtatcgtggtgagcatgctggtagcaaagcgctctgacagcgtcggcgatcgtcgtcatatcattctcttctgctgcctgatggcgctggtcaatgcgctgctgtttgcttttacccgccactatctgaccttgctgacgctgggcgtgctgctgtcggcgctggccagcgtctcaatgcctcagctgtttgcgctggcgcgggaatatgccgatcagtcggcgcgtgaagcggtgatgttcagttcggtgatgcgtgcgcagctgtcgctggcgtgggtgattgggccgccgctctccttcgcgctggcgctgaactacggctttgtgacgctatttatggtggccgccgcgctgtttctgatctgtatcctgctgatctggttcaccgtgccgtcggtgccacgttcgcagcccctgatgcaaagcggcgggctgccgctaagtggctggcgcgatcgggatgtgcgtttactgttcctggcctcagtcgcgatgtggacctgcaacactatgtatatcatcgatatgccgctctatatcagcaccacgctgggcctgcccgagaagctggccggtctgctgatggggacggcggcagggctggagatcccggtgatgctgctggccggacattacgcgcggcgtatcggcaagcgccggttaatgctgatcgcggtggcggctggcgtactgttttatctggggctggtgctgttcaattcccgcacgtcgctgatggtgttgcagctgtttaacgcggtgtttgtcgggattattgctggcatagggatgctgtggtttcaggatctgatgccaggacggcctggtgcagcgaccaccatgttcaccaactcgatctcgaccggcatgattctggctggggtgattcagggaaacgctgagtgagcgactgggacatgaggcggtttactggctggcattcgggctggctattgtggcgctggtgatgtcggcacgggtgcgcgacgtataaagaagaaaggcgtaatgccagtcagttaagcgacaggtgataacgcagtctggtgccgggcaggggctggcggtcctcgcgccgctgcgcggttccttcacttcattcctctgcctgacggaccgccggggatggcacatcctgtgccgccccgcctttcgcccgcgtcctgcgggctctcctggcagactcattctgttcagcgctgcggattgcctgctcctgcccggcaccggcctgctctgaaacttcagcgtgtattgttaaaaagggcacgagagtcgaggcctgagcgcctctgctgctgaaagggttatccgcagcgctgaggcgtgacggtgggccagaagtccacgccgggaagcgtggacaggtcggggccggccagggagggccgatccccgaacggttcgtcggcacgacgtcaaagccgaaggaaccgcgtgagcggcgcgaggacggcccggcagcagcagaggtgcgctggcccgcactgcggctcgctcgcccggaaaaaaagctgccacgtttgaccgtgacagcctttacaaatctaatcttaactgatcagcattacgacccgatgtcgccctgctttaactcaatcagcgcaggaaggcgggctgattctgctcatactgcgaaatggaggcttcgtgctgcagcgtcagaccgatgctgtccaggccgttaatcatgcagtggcggcggaagctgtcgagctcgaacgaatagactttatcgccagcggtgaccgtctgcgcttccaggtctaccgtaaagctgatgccgggctggtccgcaaccagtctgaacagctcatccacttcctcttcgcttaacttcaccggcagcagctggttgttgaagctgttgccataaaagatatccgcgaagctcggcgcaatcaccacgtgaaaaccaaaatcggtcagcgcccagggcgcatgctcacgtgaagagccgcagccaaagttttcacgcgccagcaggatgctggtgcctttgaactcaggcttgttcagcacaaagccgggcgttggcacggtgcccgcgtcatcttcaaagcgccagtcgtggaacagatgctgtccaaaaccggtgcgggtgaccttttgcaaaaactgcttgggaatgattgcgtccgtatcgacgttcgcggcatccagcggcgcaacaatgccggtgtgctgagtaaatttattcgccatgacttaagctcctgtcgtcagttcacggatgtcggcaaagtggccggttacggcagccgccgcggccatcgccgggctgaccagatgagtacgtccaccacggccctgacggccttcaaaattacggttgctggttgacgcgcaacgctcgcccggattcaggcggtcattgttcatcgccagacacatagagcagcctggcagacgccattcaaagcccgcttccaggaagattttgtccagaccttccgcttcggcctgcgctttcaccgggcctgaacccggtaccaccatggcgaccacgccaggcgcgactttgcggcctttggcgatggcggcggcggcacgcagatcttcgatgcgtgagttggtgcaggagccgataaacactttatcaatcgccacatcagtcagtttgatgcctggctgcaggttcatgtaggccagggctttttcggctgaggcgcgctcaaccggatcggcgaacgaggccggatttggtatcacctgatcaacggcaataacctgacccggattggtgccccaggtgacctgcggtgcaatctcttcagcatgcagcgttaccaccgcatcatatttcgcgccttcgtcagacttcagggtgcgccagtaatcaacggcctgctcccatttctcaccctgcggcgagaactgacgacctttcagatagttgaaggtggtctcatccggtgccaccaggcccgctttcgcacccatctcaatcgccatgttgcacagggtcatacgaccttccatgctcagcgcctgaatcgccggaccgcagaattcgaccacatagccggttccgcctgcgctgccggttttgccgatgatcgccagcacgatatctttagccgtaatgccggttgacgcctggcccagcacttcaatcttcatggtttttgcccgaccctgtttcagggtctgggtagcaaacacatgttcaacttcagaggtgccgataccaaaggccagcgagccaaacgcaccgtgcgtggcggtgtgcgagtcgccgcacacaatcgtcatgcccggcagcgtcatgccctgctcaggaccgataacgtggacgatgccctggaaacggatgattcaggtcatacagctgtacgccaaactcagcgcagttcttcatcagctcctgcatctgaatacgcgccatctctcccgacgcattgatatctttggtctgcgtagaaacgttgtgatccatggtggcaaaggttttgcccggctgacgaactttacgtccgtgcgcgcgcagaccatcaaaggcctggggcgaggtcacctcatggatcagatggcgatcaatgtagagtaacggcgtttcttctggcgtttcgtggacgacatgtgcatcaaataacttctggtataaggttttcatttttttatttttcctcggcgataaagcgggcaatgatgccgcccatctcatctgtgctgaccgctgggccatcaccggctaaatctttggtgcgatagccctgttccagcgcacggctgatggcgcgttcgatactgtcggcagcctcatcggcattcaggctgtaacgcagcagcagcgacagcgacaggatctgggcgaccgggttggcaatattctgaccggcgatatccggcgccgagccacccgcgggttcgaacaggccaaagcccgcttcattcaggctggcggaaggcagcatccccattgagccggtgatcatggcgcactcatcagagagaatgtcaccgaacaggttggagcagagcagcacgtcaaactgcgacgggtctttgatcaactgcatggtggcgttgtcgatatagatgtggctcagctgcacgtccgggtactctttggccacttcgttgacgatttcacgccacatcaccgaggtctgcagcacgttggctttatcaaccgaggtgactttgttacggcgtttgcgcgccgattcaaacgcgatgcgggcgatgcgctcaatttcgaaacggtgataaacctcggtatcaaatgcacgctcttccgggccgctgccttcacgtcctttcggctgaccaaagtagatgccgccggtcagttcacgcacgcacagaatgtcgaagcctttggcagcaatgtcggcgcgcagcgggcaaaacgcctccagtccgctgtagagtacagccggacgcaggttactgaacagcttaaaatgtttgcgcagcggcagcagcgcaccgcgctccggctgcgatgccggcggtaagtgctcccacttcgggccgccaacggaaccaaacaggatcgcgtcggcctgctcgcagcctgcaaccgttgcgggtggcaggggttcgccatgctgatcgatagcaatgccgccgaccgcatactcctgggtggtgatctgcatatcaaagcgctgacgaatggcatccagcactttcatagcctgcgccatcacttccgggccgataccatcaccgggtaaaactgcgatatgagatgagctggacatggttatacggtttccttctgatctttaaatttgcgctgcaattcttgttcaacctgacgggcacgccagatattgttcagagcgttgaccatcgctttggcggaggactccacaatatcggtcgccagaccaatgccgtggaacttgcggccgttgtagctcacgacgatatcgacctgacccagcgcattctcgccgtggcctttcgcggtcagcttgtagttaaccagctcagcgtcgaactgggtgatacggttaatcgcttggtagaccgcgtcaaccgggccattaccggtggctgcatccgatttagcgacatcgccgcagcccagattgacagaggcggtggcggtgatgctggaaccggtctggacgttaaattcgtgcagctggaaatgttccggctcttcattctgcttgttgatgaaggccagcgcttccaggtcgtaatcgaaaacctgcccttttttatcggccagtttcaggaaggcgtcatacagtgtatccagattgtaatcctgctcggcatagcccatctcttccatacgatgttttaccgccgcgcggccagaacgtgaggtcaggttcagctggattttgtgtaagccgatcgattccggcgtcaggatttcatagttctcgcggttcttcagcacgccatcctgatggatacccgaggagtgagcgaaggcgttagagccgaccactgccttgtttcgccgggatcggcatgttgcagatctggctgaccatctggctggtacggtagatttcctgatgattgatattggtatgcacgttcatgatctgctggcgggttttaatagccatgatcacctcttccagcgcacagttaccggcacgttcacccaggccattcatcgttccttcaacctgacgcgcgcccgcctgtacggcagccagggcgttgcccgttgccatacccaggtcatcgtgggtgtgaacagagataattgctttgtcgatgttaggaacgcgattcatcagctcgccgatgatgtgggcatactcgcctggcagggtgtagccaacggtatccgggatgttgatggtggtggcaccggcgttaatcgtggcttctaccatccggcacaggtcatcaatcggggtacggccgccatcttcgcaggagaactcaacgtcgctggtgtaattgcgcgcacgcttcaccatatgcaccgcacgctcaatcacttccggcagcgtgctgcgcagtttggtggcgatgtgcatcggtgaggtagcgataaaggtatgaatacggaaggcttcggcaacgcgcagtgattcgtacgccgcatcaatatctttttccacacagcgtgccagaccgcaaacccgactgtttttaatggtgcgcgcaatggtctgcacagactcaaagtcgcccggtgaggagaccgggaaaccgacttccatcacatccacgcccatgcgctccagcgctaaagcaatctgcaatttttctttcacactcaggctggcctgtaatgcctgctcaccgtcgcgcagagtggtatcgaaaataatgacttgctggctcatcgtaatcatccttatgctttttctggcctggcaacgagcataaaaaaacccgcgacaggcgcgggtttttaactttcagcaggtttgaatcagtgtttgattccgcccacaagtctaccgcgcaagctgagtgcgtttagtagtagaccgagaaggcgaacagaacgaaacatggattcaaaccttataaaatgttgtgctgtacatattggtactggaatcactcagggatgtcaaccttcaatgcaggggtattcttagtggtgccagaggaagatattctgttattcaacggtcaggcagcgtaatgaacagcgccgtagtggctgcggaggcaatcgacccgggaatgagcactgattctgcgggtctttgattttattgtattgaaaattaaagactttatcgggagggtgtctcacgaggatacaggatatatcacctgctctttagcataatcgaatgcgcttcaacgatttaatggttaattacgccagaaaagaaaagtgtcaggcgattgtgggccagggcagccgggtaataagttttcgttatttcttagatcacgctgaaaataatttcttaatcagcattttcctctgcggttctgccgcgtaattagtttaatccgcgcagccaattcttatcgggcagagcctttacgcccctgccttttaatttacgtgggtttgcggtttgcctgcccggttaactgcggttatggtaatcgacctactctcagaaaaataaactcaacagatttctctgtaaccggacagcggcagttgtttccgctgtcatgcataaacataagattttgattggcaaagcaggcaccagggctttgtggtacgcgctaacgggcgtattaacagagccgggtccgcaagcctggaggcagaagatggagatgttgtcaggagccgaaatggtcgtccgttcgttaatcgatcagggcgttaagcaggtattcggttatccgggtggcgcagtgttggatatctatgatgcgctgcaaaccgtcgggggtatcgatcatattctggtgcgtcatgagcagggtgcggtgcacatggctgacggcctggcgcgcgccaccggtgaagtcggcgtggtgctcgtcacctccggacccggcgcaaccaatgcgattaccggtatcgccaccgcctatatggactcgattccgctggtgatcctctcgggtcaggttccctcgtcgctgattggctatgacgcctttcaggagtgcgacatggtcggcatctctcgtccggtagtgaagcacagcttcctggtgaaaagtaccgaagagatcccaaccgtgttgaaaaaggcgttctggctggcttccaccggacgtccggggccggtagtgatcgatctgccgaaagatattctgaatccggccaataaattgccttatcactggccggatacggtgagcatgcgctcctacaatccgactattcagggccataaaggtcagattaagcgtgcgctgaccacattgctggccgcgaagaagccggtgatctacgccggtggtggtgccattaccgcaggctgcgaagccgaactgttaaagctggccgaaagcctgaatattccggtgacgacctcgctgatgggcctgggcgcgtttccccggcactcatcgtcagtgcgttggcatgctcggtatgcatggcacgtacgaagccaacatgacgatgcacaataccgacctgatttttggtattggtgtgcgcttcgatgaccgcaccaccaacaacctggcgaagtattgtcccaacgccacggtgatgcatatcgatatcgacccgacctctatttctaagacggtggcagcggatatcccgattgtcggtgatgcgaagcaggtactgcagcagatgctggagttactggcgcaaagcgaaagccagcgcgctgagagcctgcacgactggtggcaggagattgagggctggcgcagtcgtcactgcctggaatttgatcgcaccagcgacaaaatcaagccgcaggcggtgattgaaaccatcagccgtctgaccaaaggcgatgcgtatgtgacgtcggatgtgggccagcaccagatgtttgctgcgctctattatcctttcgacaaaccgcgccgctggatcaactccggcggactgggcaccatgggctttggcctgcctgctgcgctgggcgtgaagatggcgctgccggatgaaacagtcatctgcgtaacgggcgatggcagtatccagatgaacattcaggagctttccaccgcgctgcagtacgatctgccggtgctggtgctgaacctgaacaaccgggtgctgggcatggtgaagcagtggcaggatatgatctactccggtcgtcactcccagtcttatatggagtcactgcctgacttcgtgcgtctggcggaagcctacggccacgtcgggatcgcgattgagcatccggctgagctggaagagaaactggcgctggcgctggaaaccctggcgaagggacgtctggtattcgtagatgtcaccgttgacggtagcgagcatgtttacccgatgcagattcgcggtggcagcatggatgagatgtggttgagcaaaacggagaggacataattatgcgtcgtattttatcagttctgctggagaacgaatccggcgcattatcccgtgtcgtcggcctgtttctcgcagcgcggctataacattgagagcctgaccgtagcgccaacggatgatcctacgctgtcgcggatgaccattcagacggtgggcgatcagaaggtgctggagcagattgaaaagcagctgcacaagctggtagatgtgctgcgcgttaccgagctggggcagggcgcctatgttgagcgcgaaatcatgctggtgaagattcaggcgagcggctacggacgtgaagaggtgaagcgtaacgccgagatcttccgcggtcagatcatcgacgtgacgccgacgctgtacacggttcagctggcaggcaccagtgacaaactggacgcctttctgagtaccgtccgcgatgtggccgaaattgttgaagtggcacgctccggtatcgtcggcgtttcacgcggcgatcgtatcatgcgttaatcacgcagcgtcatcatcaatcctcacctaacccggcgaaatgccgggtttttttattttttatgcgccaggcgagttacattcagaaaagcggttgctccgcgcacttttctgctgttagatgatagccatgagttatccatagcttaactgcggctatttctgccgtaaaagcggatttgatggtggggttatcgtgaaactggatgaaattgcgcgtttggcaggcgtgtcgcgcaccacggccagttatgtgatcaatggcaaagcgcggcagtatcgtgtcagcgacaaaaccgttgagaaagtcatggcggtggtacgtgagcataattatcaccccaatgcggtggctgccgggctgcgcgccgggcgtacgcgctcaattgggttagtgatccccgatctggaaaataccagttatacccgtattgcgaactatcttgagcggcaggcccgtcagcgcggctatcagctgctgatcgcctgttctgaagatcagcccgataacgagatgcgctgcattgagcatctgttacagcggcaggtcgatgcgatcatcgtctctacctcgttaccgccagagcatcccttttatcagcgctggatcaacgatcccctgccgattattgcgttagatcgcgcgctggatcgtgaacatttcaccagcgtagtgggtgccgatcaggacgatgcccatatgctggcggctgaactgcgtcagcttgaggtcaaaaatgtgctgttcctcggtgcattacccgagctgtcggtaagtttcctgcgcgagctgggtttccgcgatgcatggaaagacgatccccggccgattgactatatctactgcaatagcttcgaaacgcacagccgccgcggcactgtttgaacaataccttgaagatcatccgatgcccgaggcgctttttaccacctcatttggtctgctgcagggtgtgatggatgtgacgctgaaacgagacggacggcttccgaccgagctggccatcgccacctttggcgaccacgaattactggactttcttgagtgtccggtgctggcggtgggtcagcgtcatcgcgacgtggcagagcgcgtgctggaattagttttagcctcgctggatgaacccagaaaaccaaaacccgggttaacccgcattcgccgtaatttataccgtcgcggacaattaagccgaaaagttaaatgagccacgggcagtattacgctgcccgcccattttatttaacgatttaactgattaaataaacaggtcgacgtaaaaaagcgtaaattctgctcatcaaatctaacaaagcagaaagggttatttttattatctgcttacaacttcaacaaacttactttcccgtctggccttaagccgctgggcttcctttcggaaatcccctaaaatgccgccgctgtctcagaaaccacgattaatatttagccctttacattgtttcatttttagtcgttttttcccgggtcgttttttttattcaggtattcatcggcttaatttttactttccccttttattcgtttatatcgtcgccagagattaattcttcactctgtaaagagtgatattcacctgccgctccggcttgacaaggatttcatgggatccttaaactcgtttcgtggtaaaaagtgggataaagtggcgtaaatgggtgatgaggagaagagactggcatgttccgcggagcaacgttagtcaatctcgacagcaaagggcggctcgccgtacctacgcgatatcgcgatttgctgattggggagtctcaggggcagatggtctgtaccatcgacctccaccagccatgcctgttgctttataccctgcccgaatgggaaatcattgaaaaaaagctggcacgcctttccagtatgaatccacttgagcgccgcgtgcagcgtttgctgctggggcatgccagtgaatgtcagatggataatgcaggccgcctgctgctggcgaatacgcttcggcagcacgcaaaattaaccaaagaagtgatgctggttggacagttcaataagtttgagctgtgggatgaacagacctggtatcaacaagtcagggacgatattgacgcagaacagtcggctcaggagcctttatctgagcggttgcaggacttgtcgctatagctatgcaggaaaatttcaaacataccaccgtgctgttggatgaggcggttaacggcctcaatatcagggaagacggtatttacatcgacggcacttttggtcgtggtggccattcacgcctgattctttcgcagctgggagagaagggaaagctgatcgccatcgatcgtgatccgcaagctatcgccgctgccgcagagatcaccgacccgcgtttttcaattattcatggccctttttccgcgctggcagagtatgtctctgaacgggatctggtcggaaagattgacggcattttgttggaccttggggtttcatcaccgcagctggatgacgccgaacgtggcttctcctttatgcgtgacggaccgctggatatgcgaatggacccgtcgcgcgggcactccgccgcagaatggttgctgcacgcagaagaggcggatatcgcgtttgtcctgaagacctacggtgaagagcgattcgccaaacgcatcgcccgggccattgtcgagcgtaatcgtgaacagccgatgacccggacccgggaaactggctgaggtgatctcaattgccatgccggtaaaagataagtttaagcatccggccacgcgcagcttccaggcgattcgtatctggattaacagcgaactggaagagatcgatattgccctgaaaggcgctgttgaagtgctggctccgcagggtcgtctctctgttatcagcttccattcactggaagatcggctggtgaagcgctttatgcgcgatcagagtcgcgggccgcaggtgccgcctgggattcccatgactgaacatcagctgcgtgccctgggtgggcgtgaactgaagttgctcggcaaaatgtcgccgggtgacgctgaagtctctgaaaacccacgtgcgcgcagctcggtattacgtatcgcggagaaaaccgacgcatgatcggtaatgagcgtcacagtctgcctgccgtcatcggcggggatctgctgcgaaaaggcaagattccggtgctgttgctgatcgctgtggtggtttctgccgtgctggtggtgactaccacccataaaacacgactattaaccgcgcagcgcgaacagctggtgctggagcgtgacgcactcgatatcgagtggcgcaacctgatcctggaagagaatgcactgggcgatcacagccgtgttgaacgcatcgccaccgagaagctgcaactgcagcacgttgatccttcacaagaaaatatcgtggtgcagaaataaggacctcagatagcgaatgagcggcacaggcagaacgctgaaattgaagaaaccggaagataaagccagctttgtaagctggcgttttgcgttgctgtgcggctgtattttactggcgctgggtggattgctgtcacgtgtagcctggctgcaggtgatcaatcctggcaagctggtaaaagagggcgatctgcgctcgctgcgtgttcaggcggtgcccacctcacgcggcatgatcagcgatcgcgccggacgtccgctggcagtcagcgtgccggtcaacgctatctgggccgatcccaaagagctgcacgccggtggcggcgtgacgctggacagccgctggaaggcgctttccgatgcgctctctattccccttgatcagctggctgcccgcgtgaatgccaatcccaaaggccgctttgtctatctggcgcgccaggtcaatccggctatcggcgactacgttaaaaaactcaaacttcccggtattcatctgcgcgaagagtcgcgccgttactatcctgccgggcaggtcacctcccatctcattggctttaccaacatcgacgggcagggcattgaaggcatcgagaagagctttgataagtggctgaccggtgcacccggcgagcggacggtgcgcaaagatcggtacggtcgggtcattgaggatatctcttcggtggacagccgggccgctcataacctgacgctgagcatcgatgagcggttacaggcgctggtttaccgtgaactgaataacgccgttgcctttaacaaagcggaatcgggtacggcggtgctggtggatgtcaataccggtgaagtgctggcgatggccaacagcccggcttacaacccgaacaatctcggcaatacgccaaaagatctgatgcgtaaccgcgccatcaccgacattttcgaaccgggctctaccgtgaagccgatggtggtgatgacggcgctgcagcgtggtgtggtgagagagaaacagtgtcctgaataccgtgccgtaccgcgtcaatggtcatgagatcaaagatgtggcgcgctacaacgaattgaccctgacaggggttttacagaagtcgagtaacgtcggtgtttcacgtctggcgttagcgatgccttcctcagcgctggtagaaacttacgcgcgctttggactgggcaaaccgaccaatttggggctggtcggggaaagcagtggcttataccctaaaaaacaacggtggtctgacatagagagggccaccttctctttcggctacgggctaatggtaacgccgttacagttagcgcgagtctacgcaacgattggcagctatggcattaatcgcccgctgtcgatcaccaaagtggatccgcccgtcgcgggacaacgcgtttttgatgagtcactggtgaaaaccgtgatgcacatgatggaaagcgtggcgctgcccggtggcgggggcgtcaaagcggcaatcaagggttatcgcattgcgataaaaaccggtacggcgaaaaaggtcgggccggacggacgctacgtcaataaatacattgcctacaccgcaggcgtcgcgcctgccagtcatccccgattcgcgctggtggtggtgatcaacgatccccaggccggcaagtattacggcggtgcggtctctgcaccggtatttggagccatcatgggtggcgtactgcgtaccatgaacatcgagccggacgcgttaccgaccaatgacaagaatgagctggtgactaacagaagtgaggaatcaagtgacagatcgtaacctgcgcgatttactcggcccctgggtgccaggcgcgccggcgcgcccactgcgtgacatgaccctggatagccgcattgcggcttctggcgatctgtttgtcgctgttgcaggccatcaggttgatggacgccgtttcattccgcaggcaattgcgcagggcgttgccgctgtggtggcggaagctgagggtgaagcggtcgacggcgaaatccgtgaaatgcacggcgtaccggttatctatctggcgcagctgcatcagcgcctttcggccctggcaggccgtttttatcagcagccgggcgaaaaacagaagctgattggcgtcaccggcaccaacggtaaaaccaccaccacccagttgctggcgcagtgggcgacgctactgggtgagaccagcgcggtgatgggcaccgtcggaaatgggctggtaggtcacttagcggcggcagaaaataccacgggttcagcggttgatgttcagcatctgctgcacgatctggctgaaaaaggggcgaccctgaccgcaatggaagtctcgtcacacggactggttcagcatcgcgtcgctgcgctgccgtttgccgcagcggtcttcaccaatctcagccgcgatcacctcgattaccacggtgatatgcagagctatgagtcagctaaatggctgctcttttctgagcatcaggtcgggcaggcgattcttaacgcggatgacgaagtcggtcgtcgctggctggcgcgcttacctgatgccgttgcggtcaccatggaggataacctccagccgggctgccacgggcgctggcttaaagccgatgcggtggattaccacgataacggcgcacatattcgttttagctccagctggggcaacggcgaaatcgacagtccgctgatgggtgccttcaacgtcagcaatctgatgctggcgctggcgacgctgctgtcactggattatccgctggcgacgctaatcagcgttgcaccgcagttgcagccggtcaacgggcgtatggaagtgttcagcgccgcaggaaaaccgacggttgtcgtggattatgcccacaccccggatgcgctggaaaaagcgctggaagcggcacgcctgcactgcaaaggaaaactctggtgcctgtttggctgcggcggcgaccgtgacaaaggcaaacgcccgttaatgggcgcgattgctgagcaatatgcggatgtggtggtgattacggatgacaatccgcgcagcgaagatccgcaggcgattgtaaaagatattctgaccggtttgctggacccaggccgcgcccgcgtggtctctggtcgtgcgcaggcggtcactaacaccattatgcaggcgcagcccgacgatatcgtactggtggctggcaaaggccatgaagattatcagatcattggcaatcgccgtctcgactactccgatcgtgccaccgttgcggcactgctgggaggcgttgcatgattccggtttcattaaaaaccctggcggagatcaccggcggcacgctgcacggcagcgatttaacgctgagtgacgtgaccaccgatacccgcaaagtgacggcgggcagcctgtttgttgcgctggtgggcgaacgctttgatgcgcacgacttcgccggcgatgccattgcgaatggcgcacaggcgctgctggtaagtaagcatttacctgtcgctgtgccacaggtggtggttgaagatacccgtctcgcctttggcaggctgggcgcatgggttcgtcagcagtcgaccgcccgtgtagtggcgctgaccggctcctccggcaaaacctcggttaaagagatgacggcggcgattctgcgtcagtgtggcgaaacgctctacaccgcaggcaatctcaacaacgattatggcgtaccgatgacgctgctgcggctgaccgcagaacatcagtatgcggtcatcgaaactcggtgcgaatcatcagggcgaaatcgcctacaccaccggactggttcaaccggaaagcgcgctggtgaataacctggccgcggcgcatctggaaggctttggttcgctggccggtgtcgctaaggccaagggcgagattttccagggcttaccggctcacggcattgcgattctgaacgcagagagcaatgactggcccaactggcagcgcacgctgcaggataaaaccgtgtggcgtttctcaccgcaggcggcagagtgtgaattctccgcccgtgatatccgcattgctcaggatggtactcattttgtgatgataacgccgcgtggcgaagctgagatcgtgctgccattgccgggtcggcataacatcgccaacgccctggcggcggcggcactggctctgtcagtggatgcaccgcttagcgccgttcagcaggggctgaaaaacctgcagtcggtgccaggtcgcttgttcccggttcgcctctctgcgcatcagctgctgctggatgacagctataacgctaacgtcggttcgatgactgcggccgttcaggtcctgtcagagatgccgggttaccgggtgctggtcacgggtgatatggcggaactgggtgaagagaccgaaagttgtcaccgcgaagtggggcaagcggcacgtgatgcaggcattgatcgcgtgctgagcaccggaaaattcagccatttcatcagtgaaagcagtgaagttggcgaacatttcagcgataagactgcgctgactgaacgtttgcgtcaattgttgtccgaacactcagaaattaccgtcctgataaaaggttcacgtagtgccgccatggagcaggtagtacagagcttaaaggagaaaggaacatgttagtttggctggccgagcatctggtcgctttttattcgggatttaacgtcttttcctatctgacgtttcgcgccattgtcagcctgctgaccgcgttattcatctctctctggatggggccgcgcctgatcgcctggctgcagaaattacagattggtcaggtcgtccgtaacgatggcccggaatcgcatttcagtaagcgcggcacgccgaccatgggcggcatcatgattctgacctccatcaccatttcggtgctgatgtgggcatatccgtcgaatccttatgtctggtgcgtgctgttcgtgttaatcggctttggcatcatcggctttgtcgatgactaccgcaaagtggtacgcaaagacaccaaaggcctgatcgcccgctggaaatatttctggatgtcggtaatttcgctgggcgtcgcgttcgggctctatgcggcgggcaaagatacccccgcgacccaactggtcgtgccctttttcaaagacatcatgccgcagctaggtctgttttatgtgctgctggcttactttgtgattgtcggaacgggtaatgcggtcaatctgaccgatggcctggatgggctggcgattatgccaaccgtctttgtcgccgcgggctttgcgctggttgcctgggccaccggtaacgtgaagtttgctgaatatctgcacattccctatctgcgtcacgccggtgagctggtgattgtctgtaccgccattgtcggggcagggctgggcttcctgtggttcaacacctatccggctcaggtctttatgggcgacgtgggtttcgctggcactgggcggcgcgctgggcaccattgcggtgttgctgcgtcaggaatttttactagtgatcatgggcggcgtgtttgtggttgaaacgctgtcggtgatcctgcaggtgggatcgtttaagttgcgcggccagcgtattttccgcatggcgccgatccatcaccactatgaacttaagggctggccggaaccgcgcgtcattgtgcgcttctggattatttcgctaatgctggtgctgattggcctggccacgctgaaggtgcgttaatcatggctgactatcggggtagaaaagtcgtcatcatcgggctgggcctcaccgggctctcctgtgttgatttctttttagcgcagggcgtaacgcctcgcgtgatggacacccgtgtctcgccgccggggctggataaattgcccgggcaggttgaacgccatctgggcggcatcaacggcgactggctgctggcggccgatctgattgttgccagccctggcgtcgcgctggcgcatccgattctcagcgaagctgtcgaagccggcatcgaaattgtcggtgacattgagctcttttgccgcgaggcgcaggcgccgatcgtggcgatcaccggctccaacggtaaaagcacggtgactacgctggtgggtgaaatggcgaaagccgcaggctggcaggtgggcgtcggcggcaatattggtctgcccgcgctgagtctgctgcagtcaccggcgcaactctatgtactggaactttcgagttttcagctggagaccacgcacagtctgaaagccgcggcggcaaccatacttaacgtcagcgaagatcatatggatcgctatccgctgggtatgcagcagtatcgcgccgctaagctgcgggtctatgagaatgcacaggtctgcatcgttaacgccgatgatgccctgacgatgccggtacgcggcgcggacacacgctgcgtcagctttggtgtcgatttcggggactaccaccttaacaagcagcagggcagtatctggctgcgggtgaaaggcgagaaggtccttaacacggctgaaatgaagatggtgggacagcacaactacaccaatgcgctggctgcgctggcgctggccgatgcggtgggtctgccacgagcttccagtctggctgccttaacgcactttaacggtctggcgcatcgcttccagctggtccatgagcatcagggcgtgcgctggatcaatgactccaaagccaccaacgtcggcagcaccgaagcagcactgaatggcctgcaggtgaagggaacgctgtggctgctgatgggcggtgatggcaagtcggccgattttacgccgctgatcccctggctgcagggcgacaatgtgcgcctttactgctttggtcgcgatggcgatgcgctggcggcgctgcgtcctgaaatcgccgtgcgcactgagaccatgcgccaggcgatggagcagattgcgccgcaggttaaagcaggcgatatggttctgctgtcgccagcctgcgccagccttgaccagttccgtaactttgagcagcgcggtgagcagttcgcgcaactggcgaaggagctgagctgatgcgtattcctggcgccggactggcgggatatttctcaggacgcctgaaagactgggtcatgggcgcacgcgaaagtgatgactcttcgctggtgctctatgaccgcacactgctatggctgacgctgggcctggcggtgattggtttcgtgatggtgacgtcggcttcaatgccggtgggtcagcgtctgaatgacgatctcttttatttcgccaagcgcgatgccttctacatcgtgctggctgtatgtatggcgctggtcacgctgcgggtgccgatggatttctggcagcgctacagcaacgtgatgctgatggtcacggtcgcgatgttgctgattgttctggtggtcggtagctcggttaacggtgcatcgcgctggatcgcgctgggtccgctgcgtattcagcctgcagagctgtcgaagctctctctgttctgctatctcgccagttatctggtgcgcaaagtggaagaggtgcgtaacaacttctggggcttctgtaagccgatgggcgtgatggtggtgctggctgtgttactgctggcgcagccggatctcggtacggtggttgtgctgtttgtgacgaccctggcgatgctgttcctggcgggcgccaaactgtggcagttcctggcaatcatcggttccggcatctttgcggtgatcctgctgatcattgcagaaccctaccgtatgcgccgtgtgacctcgtttctggaacccgtgggaagatccctttggtagcggctaccagctgacccagtcactgatggcatttggtcgcggggaattctggggccaggggctcggtaactccgtgcaaaagctggaatatctgcccgaagcgcataccgactttattttcgccatcatcggggaagaactcggctacgtcggtgtggtaatggcacttttaatggtattcttcgtcgcttttcgtgcgatgtcgattggccgtcgtgctctggaactggatcagcgtttttccggctttttagcctgttcaatcggagtctggttcagcttccaggcgctggttaacgtcggtgcagcagccggtatgttaccgaccaaaggtctgaccttaccgctgatcagttacggtgggtcaagtctgatcattatgtcgactgccatcgtctttttattacgcatagattatgaaacgcgcctggcgaaagcgcaggcgtttacccgaggtggtcgatgagcggtaagcgattgatggtgatggcaggcggaaccggcggacatgtctttcccggtctggctgtcgcccatcatctgatggaacagggctggcaggtccgctggttaggcactgccgaccgtatggaagccgatctggtgccaaagcacggcatcgacatcgacttcatccgcatcagcggattacgtggtaaaggcatgaaggcgttgctgctggcaccgctgcgcatctttaatgcatggcgtcaggcccgtcgcatcatgaaggcctggcagccggatgtggtgctgggcatgggtggctacgtttccggtcctggcggcttagcggcctggagttgcggtattccggtggtgctgcatgagcagaacggtattgccgggctgaccaataaatggctggcgaaaatcgctacgaaagtattgcaggcgtttccgggcgcgtttcccgccgccgatgtggtgggaaatccggttcgcactgatgtactggcactgcctttacccgcgcaacgtctggcagatcgtcatggcccgatacgggtgctggtgatcggtggcagtcagggggcgcggatactgaaccagacgctgccgcaggttgccgcgctggtgggtgatgagatcaccctgtggcatcagaccggtaaagggtcgttgcccgaaacagagaaagcttatcagcaggtcgggcagacgcagcacaaggtgaccgagtttattgatgacatggctgccgcctacgcctgggctgatgtggtggtgtgccgctccggcgcgttaaccgtgagcgaagtcgctgccgctggcttaccggcgattttcgtgccatttcagcacaaagatcgccagcagtactggaacgcgctgccgctggagaaagcgggcgccgccagaatttttgagcagccgcaatttactgcggaggctgtagcggatcagctacgccactgggatcgcgcaacactgctgacgatggctgagcaggcccgtcaggtggcgatccccgatgcgactgaaacgggtcgctcaggaagtggctcgcgccgcaaagtaatcattccggtcagcgcgtctgacctgtacccggactgggtacaaactgaaatagcaggtaactgagagcgatgaatacacaacaattggcaaaactgcgttctatcgtgcccgagatgcgtcgcgtccggcacatccactttgtcggcatcggcggtgctggcatgggcggtattgccgaagtgttagcaaatgaaggctaccatatcagcggttcagatctggcccctaacccggtgacgcagaacctgattgcgctgggtgccaccatttattttaaccatcgccccgaaaacgtgaccgatgccagcgtcgtggtggtttccagcgccgtttcgcaggataaccccgaactggtggcggcacgtgaacagcgtatcccggtgatccgtcgcgcggagatgctggctgagctgatgcgttttcgtcacggcatcgccgttgcgggtacccatggcaaaacgaccaccacggcgatggtgtcgagtatttatgcggaagcgggtctcgatccgacttttgttaacggtggactggtcaaagcagcaggcacccatgcccgtctgggtcacagccggtatctgattgctgaagcggatgagagtgatgcgtcgttcctgcatctgcaaccgatggtggcgattgtgaccaacatcgaagctgaccatatggacacctatcagggcgattttgagaacctgaagcagacgtttattaacttcctgcacaacctgccgttttacggtcgtgcggtgatgtgtgtggatgatgcggttattcgtgatctgatcccacgcgtgggacgccatatcaccacgtacggtttcagtgatgatgctgacctgcgcattgaaaattatgaacagagtggcgcgcaggggcatttcaccttgatccgtcaggataaagcaccgctgcagattacgctgaacgcgccgggtcgccacaacgccctgaatgcggcagccgccgtcgccgtcgccagtgaagagggcattgaagacaatgctatcctggctgcgctggagagtttccagggcacgggccgtcgctttgatctgctgggtgaattcccgacagagccggtcaacggacagccgggcaccgcgatgctggttgatgattacggtcatcatcccaccgaagtggacgcgacaattaaagccgcgcgcgcaggctggccggataaaaaactggtgatggtgtttcagccgcaccgttacagccgaacccgcgatctgtttgatgatttcgccaacgtactgtcgcatgtggatgtgttgctgatgctggatgtttactctgccggtgaaaccgctattccgggtgctgacagccgttcgctgtgccgtgcgattcgtaatcgcggcaaggtggatccgattctggtgccggaacatgacgcgctgccagagatgctggcaccgctactgtcaggcaatgacctgattctggtgcagggagccggtaacgtcggcaaggttgcccgcaagctggctgacactaagctccagccggaacgcaaagcggaggatcgtcatggcggataaagttgcagtattaatgggtggcacctcggcagagcgcgaggtttcgctgaactcaggtcaggccgtcctcgccggattacgggaaatgggcattgatgcgcatggcatcgatacccgtgatgtctctgtgctgacgctgaaagagcagggctttaccaaagcctttatcgcactgcatggccggggcggagaagatggcacgctgcaggcggtgctggagttcctgcaactgccgtacaccggcagcggcgtgatggcatcggccgtgactatggataagctgcgcaccaagctgctgtggcagggacgtggtttaccgtcaggaaagtttgtctggctgacgcgtcagcagtttgatgccggtctggacgcagaaaacaacgcggcaattgcggcacttggcctgccgttgttcgtcaagccagcctgtgaaggctccagcgtgggcatcagtcgggttaacgatctgagcgcgctgccggcggcactggacatggcgtttaagcatgacaatgacgtgctggtcgaagcgtttctcagcggcgcggagtacaccgtcgcgattgtgggcgatcgtattctgccctcgattgaaataaagagcgccagcgagttctatgactatgaagctaaatacatttctgacgatactcagtacgtctgtccggccgatttaagcgctgaacgtgaagcggaattacaacagctggtactggcggcctggcgtgcgctgggatgtcgcggctggggacgggttgatgtgatgaccgacggggaggggcgctttcagttactggaagccaatacctcaccgggcatgaccagccacagtctggtgccaatggcagcgaaacaggcgggcatgagcttcccgcagctggttgcccatattctggagctggccgactgatatgtcacaggcggcgatgagagttcgaaaccgtgaaccgcaggagcgtattcgcaccgggcgcagtaacggtgcccgactgttcggcattatttttctgctgatcgtcatcgggattatggttgccggcgggctggtggtactgaagtggatgaacgatgcgtcccggctgcccttgtcaaaactggtggtgacaggacagacgcactacaccacacacgatgatattcgtcaggcgattttgtcgctgggtccgcctggtacgtttatgtctcaggacgtggacatcctgcagcagcagattgagcggctgccctggattaagcaggtcagcgtacgtaagcagtggccggacgaactgaagatccaccttgtggagtacacaccggtggcgcgctggaacgatttgcacatggtggatgctgagggtgtctccttcagcgtacccgccagtcatgtcggcaaagagacaatgccgatgttgtacgggccggaagggagtgagaaagaggtcctggcgggctatcacagcatggatgatgtgctgaaagcccggaagtttactctgaaggtggcgtcgatgacggcgcggcgttcatggcagctggtcaccagcgacgatgttcgtatcgaactgggccgcagcgacaccatgaaacgactgaatcgctttattgagctctacccggtgctgcaacagcaaggtcagaacgagagcaaacgtatcagctacgtggatttacgatacgactctggcgcttctgttggctggacaccgatcgtgatggagccacaggacagtaatcagcaacagaaccaggcacaggctaaacaacaatgatcaaggcaacggacagaaaactggtagttggactcgaaatcggcactgcgaaggttgccgccctggttggggaagttctgcccgatggtatggtcaacattattggggtgggcagctgcccttcccgcggtatggataaaggtggcgtaaacgaccttgagtcggtggtgaaatgcgttcagcgcgccatcgatcaggctgagctgatggcagactgccagatctcctccgtctaccttgctttatcgggcaaacatattagttgtcagaacgaaatcgggatggttccgatttccgaagaggaagtgactcaggatgatgtagagaacgtcgtacataccgccaaatcggtgagagtacgtgacgagcatcgcatcctgcacgtcattcctcaggagtacgccattgactatcaggaagggattaaaaatccggtcgggctttctggcgtgcgtatgcaggcgaaagtgcatctgatcacctgccacaacgacatggcgaagaacatcgttaaagccgttgaacgttgcgggctgaaagtggatcagctgatttttgccggtctcgcctccagttttgccgtttctgactgaagacgaacgtgagctgggcgtgtgtgttgtcgatattggtggcggtacaatggacatagccgtatataccggcggcgctttacggcacactaaggttattccgtatgcaggcaacgtcgttaccagcgacatcgcctatgcgtttggtacaccaccaacggatgctgaggcgatcaaagtgcgccatggttgcgcgctgggctcgattgtcggcaaagatgagaacgttgaggtgccgagtgtgggcggacgtccaccacgtagcctgcaacgtcagacgctggctgaagtgattgagccgcgttataccgaacttttgaatctggtcaatgacgagattctgcagttacaggaacaactgcgtcagcagggcgtgaagcatcacttagccgcaggcattgtcctgaccggtggtgcagcgcaaatcgaaggactggcggcctgtgcgcaacgcgtattccatacgcaggtgcgtatcggacagccgctgaatattaccggcctgactgactatgcgcaggaatcgtactactccactgccgtgggactgttgcattacggcaaagagtcgcacatgaacggtgatgcagagaccgaaaaacgggtctcagtaggtaactggttcaagcgtattaacagttggttaaaaaaagagttttaatttttgtgaaaggggatcatgctgttttctttagtgatctccaggcgacaggcacataacggagagaaatcatgtttgaacctatggaattaaccaacgacgcggtgattaaagtcatcggcgtcggtggcggcggcggtaacgccgtagagcacatggtacgcgagcgtatcgaaggtgtggaattctttgctgtgaataccgacgcgcaagcgctgcgtaaaacagctgtcggccagaccattcagatcggtaataacattaccaaaggtctgggtgcgggtgcgaacccggaagtgggccgtaactctgcagaagaagatcgcgaagcactgcgttctgcgctggaaggggcagacatggtcttcatcgcagcaggtatgggcggcggtaccggcaccggtgcagcgcctgtcgtggctgaagtggctaaggagctgggtatcctgacggtggcggttgtcaccaagccgttcaacttcgaaggcaaaaagcgcatggcgtttgccgagcaggggatcgccgaactctctaagcatgtcgattcactgatcaccattccaaacgacaagctgctgaaagtgctgggccgtggtatctctctgctggatgcgtttggtgcagctaatgacgtgctgaaaggcgccgttcagggtatcgctgagctgatcacccgtcctggcctgatgaacgtcgactttgctgacgtgcgtaccgtcatgtccgaaatgggctatgcgatgatgggttcaggcgtcgcgtgcggtgaagatcgtgcggaagaagcggctgaaatggcgatctccagcccactgctggaagatatcgacctttctggtgcgcgtggcgtgctggtcaacattacggcgggcttcgacctgcgtctggatgagttcgagaccgtgggtaacactatccgcgccttcgcctctgacaacgcgaccgtcgtgatcggtacttcactggatccggaaatgaatgacgaactgcgcgtcaccgtggtggcaaccggtatcggcatggacaagcgtcctgaaatcaccctggtaaccaacaagccagccagtcagccagtgatggatcatcgctatcagcagcacggtatgtcaccgctgccgcaggagcagaaacctgctgccaaagtcgttaacgaccaggctgcgcagtcgaacaaagagcccgattatcttgatattccggcatttttacgtaagcaggccgattaggattaaccctataattgggattctccgctctttgtgctaaagtctctgtccgctggtaaagtatactggcggtcggacaggtgatattgcgagataatacgatgatcaaacaaaggacattaaaacgtattgttcaggcgactggtgtcggtttacataccggcaaaaaagtcaccctgacattacgccctgcgtcggctaataccggggtcatctatcgtcgcaccgacttgaatccaccggtagattttccggctgatgcaaaatacgtgcgcgacaccatgctgagtacctgcctggtgaatgatgaaggcgtgcgtatttcaacggttgaacacctcaatgccgccctggcgggtctgggtatcgacaacattattgttgaagtcgatgcgccagaaatcccgatcatggatggcagcgcagcaccgtttatctatctgctgatggatgcgggcatcgagcagctcaacagcgcgaagaaatttgtgcgtgttaagcagaccgtgcgtgtggaagagggtgacaaatgggccgagatcaaaccgtttaacggcttctcgcttgatttcaccatcgacttcaaacacccggctatcgattccagctcacagcgttatgcgatgaacttctctgctgacgcctttgttcgtcaaatcagccgggcgcgtacatttggctttatgcgtgaaatcgaatatctgcagtctaaaggcctgtgcctgggcggtagcttagattgtgcgataggtctggatgatttccgcgtactgaatgaagaaggcctgcgttttgaggacgagtttgtgcgtcacaaaatgctggacgcgattggcgacttgtttatgtgtggtcacaacatcattggcgcattcactgcgttcaaatcgggccacgcgctgaacaacaagctgctgcaagcggtttctggctaagcaggaagcctgggaatgggcaaccttcgaagacgaagctgaactgccgctggcattcaaagcaccgaatctggttctggcttaattaccccggaacgtgaaacggctggttatgctgacaccctctccggtcagcggcgccagccgttttttattgcctcttatcacacgcctgatgactgcgacctcgctcgcaaagcgttgtctgttctgctgatttgctgaacaatcacacgcgttttctctcgccatcactttaatcccaggtgtggatgccccacattaatgatactatctgtggcgcttttacaggccgaaatccgttgcggctcgcggcgggtaccagaaaacaagagcgcaacagagcatgcgcgatggaaaggttgtgatcgggattcttctgcgctggcgacaattaggtagacgctacttctggcctcatctcctgttagggatggtagcggccagctttggcctgccagcctgtgcgcaaagctccgaactcaacgcgtcgtctgaatctccggccagcagtctctttcttggcaatgccacacgctttgatcatctgatccggctgcaggaagcgtcccgacgcccgagcttcagcgtggattactggcatcagcacgccatccgcaccgttattcgtcatctctctttcacgctggcgccccaggcgcaggcggagcaacagacattaccgctggcggcacaaaagctggcgctgatcgactcactgcatagtttactgacatcacattctgcgctgcacactgcaccgcagcagatctctacgccgcctcttttcacggccgttacccgttcatgggtagagtggcatgccagcgtgcatggcattcgcgccggacctgcccgattgttctgctaatatttttggttttattcactctgttaagatttcgcagtccggaatgctccggctgaattgagaatatatttactatgttaagcaaaattttaaccaaggtttttggtagcagtaacgatcgtaccctgcgtcgtatgcgtaaagtggtggatgtcatcaataagatggagcccgattttgagaagctctctgaggatgaactgaaagcgaaaactgatctgttccgcgaacgcctgaaaaaaggtgaatcgctggaaagcctgatcccggaagcgtttcgcaaccgtgcgtgaagcgagtaaacgcgtgttcgggatgcgtcacttcgacgtgcagctgatcggcggcatggtgctgaacgatcgctgcattgctgagatgcgaaccggtgaaggtaaaacgctgaccgcaacgctgccagcctacctgaatgcgctgtccggcaaaggcgttcacgtggttaccgtcaacgactatctggcacagcgtgatgcggaaaacaaccgtccgctgtttgagttcctgggtttaaccattggtatcaacatgtcgggcctgccggcggtggcaaagcgtgaagcttacgcagcagacatcacctacggcaccaacaacgaatatggcttcgactacctgcgcgacaacatggctttcagcccggaagagcgtgtacagcgtaaactgcactatgcgctggtggatgaggtcgactccatcctgatcgatgaagcgcgtacgccgctgatcatctctggtccggcagaagacagttctgagctttacaccaaagtgaacaagatcatccctcatctggttcgccaggataaagaagataccgaaacccatcagggtgaaggcgacttctgggtcgatgaaaaagcgcgtcaggctcacatgtctgagcgcggtctggtcaaagtggaagagctgctggtcagcgagggcatcatggaagcgggcgagtcactctactctccgaccaacatcatgctgatgcaccacgtcactgcggcgctgcgtgcgcacgcactctttacccgcgatgtggattacatcgtgaaagatggtgaagtggtgattgttgatgaacacaccggccgtaccatgcagggtcgtcgctggtctgatggtctgcatcaggcgattgaagcgaaagaaggcgttgagattcagaacgagaaccagacgctggcctctatcaccttccagaactacttccgtatttacgagaagctggccggtatgaccggtaccgctgataccgaagcatttgaattcagctccatttataagctcgacaccattgtcgtgccgactaaccgtccgatggtgcgtaaagatctggctgacctggtctacatgaccgagaaagagaagatcgatgccattatcgaagatatccgtgagcgtactgcaaatggtcagccggtgctggtgggaaccatctcgattgagaaatcagaagtggtctctaacgaaactgacccgtgccggtatcaaacataacgttctgaacgccaaattccacgcccgcgaagcggatatcgtggcgcaggctggtcagccgggtgcggtcactatcgccaccaacatggccggacgtggtacagatattatgctgggcggcagctggcacgctgaagtggccgaactggaagagccaactgaagcgcaaatcgaagaaattaaagcggcatggcagattcgtcatgatgcggttctggcgtcaggtggtttacacatcgtcggtactgagcgtcacgaatcgcgtcgtatcgacaaccagctgcgtggtcgtgcaggtcgtcagggtgacgccggttcttctcgcttctacctgtcgatggaagatgcgctgatgcgtatttttgcctcagaccgcgtctcgaatatgatgcgtaaactgggcatgaagccaggcgaagcgattgagcatccgtgggtcaccaaagcgattgccaatgcccagcgcaaagttgaaagccgtaacttcgatattcgtaagcagctgctggaatatgatgatgtggctaatgaccagcgtcgcgcgatctacagtcagcgtaatgagctgctggatgtgtctgacgttagcgaaaccatcaacagtattcgccacgacgtctacaaagtcaccatcgatacttacattccgccgcagtcgctggaggagatgtgggacgtgccaggcctggaagagcgtctgcgtactgactttgatctaaacctgccgattgcagagtggctggataaagagcccgatctgcatgaagaagtgctgcgtgagcgcatcatgacccatgctatggaaagctacgctgagaaagaagagatcgttggcgcagagatgatgcgcaacttcgaaaaaggcgtgatgcttcagacgctggattcgctgtggaaagagcatctggccgcgatggactatctgcgtcagggcatccatctgcgcggctatgcgcagaaagacccgaagcaggagtacaagcgtgaatccttcgccatgtttgccgcgatgcttgaatcactgaaatatgaagtgatcagcacactgagcaaagtccaggtgcgcatgccagaagaagttgaagcgatggagcaacaacgtcgcgaagaagctgaacgtctggcacagcaacagcagctgagccatgttgaagaggatctgctggcagccgcagagcctgtggcggagcagagtggcgaacgcaaagtcggccgcaacgatccctgcccatgtggttccggtaaaaagtacaagcagtgtcatggccgcatcgcctgagactgaatgctaataaaaaaggagccgctggctcctttttttatggtctctgccacccaggcaacagcgactccgctgagctaaagcggttaacatccgctacggcatgctctaaaatcaggcttcattcacccattactaccggatagtctccatgaagcacctgcaggttgcagttggcatcattcgcaatgccagtaaacaaattttccttgcccagcgcgcggcgacctcttacatggcgaacaagtgggagtttcctggcggtaaaattgaagcgggcgaaagcgccgaacagggattgataagggaacttcaggaagagaccgggattgaggtcaccgaggcacgcccgattggtcatgcagaccacagttatgacgatctgcgcgtgacgttgcatttctttctggttgaagggtggaaaggagagccgtggggcaaagagggtcagccgcagcgttgggttgatcagcatgcgttggtcgcggaggagtttccgcccgcgaatcatcagctgattgcgcgtctgatcgccggcgaaactctgagcggatggggcagcgcgccccatccggttcggctgtcagcgatcttcttcactccagttgtcactgtcgttcatatcgtcgcggctgggaatgcgtttctcttctgcggcccactcacctaaatcaatgagctggcagcgcttactgcaaaaggggcgccacgggctgagttcatcccagatcacatctttgccgcactgcggacaggcaacggtcatcacttcttgctgcatttttacctctaacaacaggccagttgaaaattaaggcgggccggaacttcaccacgctcactatcaagcggcataaaacgaatggcgtagcggcttttatgtccggacacctgtggatagagcgcatcctccagcgacaactgcagtcgcaacagatcggcgccttcggcattatcctgataaaaaccattaaggctggtctgcacatgaaacgcgccggactggcggatcagatccagtatcatcgccagcgcatgatgcagtggctccagcgtcagcatccaggcttcgacctgcgcatcgcgtgctttctgtggcagatggagccagatgtgcaggcctggcaaatcaaagctgcagcatccaccagggatgctcaggcgctgccgcaccagggcaatcagacggtcctcgcggagttgctggcccatacgtggggcattcattaactgcgtcgactgaattttgagtttatcgcgcagggcattaaccagcgtcatatcaacacctggcacatcagcccatgcacgtaacttttgctgctgacgctccagctcttttaacaattcagtacgcatatcgccacgctcaaaaatgtcgagcagttcgctaatcaggcgaaaaaaggtcagcgcattaacggttttatccagtgggacaatttcatctaactgattgatcaaaaactcaacccgtaaccaggttcgcattttttcattcagagggtgttcaaacagaacgggtgtgctcatggtattaatcctgtttcgttgccgccagcctgagatagcgctgatggagttcggcaacctgcggcaaggcgtcgtcgggctcgccactgttatcaataatgtcatcggcacaggcgaggcgctgctggcgcgtcgcctgtgcggcaagaatgcgtttcgcctgcgcgacggaaagatgatcacgctgccgggtgcgcgctaactgcgttgcctcatcaacatccaccaccagtacccgatcagcctggtgctgtaactgattttccaccagtagcggcaccacccagagcacataaggtgtggtggcttcggcgatcaattgacgcgtccgggcattaatcagtggatgcagcagcgcgtttaaccagcttttctcttccggctgctgaaaaataatgtcgcgaagccggctacgatcaagcttcccctcatcagtgactatcgacgtgccatagcgcgcctgaatggcctgcaaagcgggtgtgccgggttcgacaacttcacgtgctatcaggtcagcatcaataatttccacgccagacgctgcgaatgcctgggcaatcgtacttttaccactgccgatcccccctgtaagcgcgacgatatagggcatgtttctcacctgacttctctgttcgacagggcttcagggtaatgatctgaataaaaaacgcaaaaatgcgcgtcagatcacaccgataaaccacaattaaatttaacggattgtagcgtaaataaagtgaaattcgcagtcttgtcgcgcagcgagaggcgcgtatcataacgtcactggagctgtgcttacttcgtgaacgacgattcattgccacttaccaggacactgtttatgcgtattgaagaagatttaaaactgggctttaaagatgtcttaatccgccccaaacgctccacgctgcaaagtcgctcacaggttgagctggaacgcagctttaccttcagacattcgggcctgagctggagcggcgtaccgattatcgccgccaacatggataccgtcggcacattttcaatggctgaggcgctggccagcttcaatatccttacagcagtccataagcattacagcgtagatgagtggcgcgcgtttattcagcgcgtccccgcgacggtattgaaacatgtgatggtttcaaccggcacctcggaggccgatctcaataaactggttgcgattatggcgctgtcagacgatctgcagtttatctgcatcgacgtggccaacggctattctcagcattttgttgattttctgcagcgcgcccgtgaaaccttcccggctaaaaccatctgtgccggtaacgtggtaacgggcgaaatggtggaagagctgattctctctggcgcggatatcgtcaaagtcggcattggcccgggttcggtctgtacaacccgggtgaagaccggcgtgggctatccgcagctttccgctgtcattgaatgtgccgatgcggcgcatggcttaagcggacagattgtcagtgatggcggctgttcagtgcctggcgatattgcgaaagcgtttggcggcggtgccgactttgtgatgctgggtggcatgctggcggcacatgatgagtgtgaagggcaggtggtcgaagagaatggcgaaagctttatgctgttttacggcatgagttccgaatcggcgatgaagcgtcacgttggcggtgtcgcgcaatatcgcgcagcagaaggtaaaacggtgaagctgccattacgtggcccggttgctgacaccgcgcgcgatatcctgggtggactgcgttccgcctgcacttatgtgggggcggagcggctgaaagagctgaccaagcgcaccacctttattcgggttaatgagcaggaaaaccgcgttttcaaccgatagttatccggggcgcagcctgcgccccttaatgcatcgcatcacccagcccgaacaccggcagatacatcgcaatcaccagcgtgccgacaatgccgccaatcaccaccatcatcatcggttccagcgaagcagccagtgtgtcagcgcgctcacgggtttctgcctcatgccattccgccagacgagccagcattaaatccagcgcgcccgcctcttcgccgacgcgaaccagctgaccgcataatggtgtgaacagcggatgatgcatcagcgcctgatgcagaggattcccctgagcaatgtgctgctgcagtccggccattgcttcccgccatagcaatgatgagagcgtcacttcaacggcagccagtccctgtagcaaagttaacccggcgcgctgtgtcagattcagaatggtgtagatctgcgtcagctgcgtgccacgccataacccggaaagcagcgggatgcgcaggaaaatcgcctgctcacggcgctgccagcccgcagagcgtcgtcgtaactgatgccaggctaccagcatcagcgatacgccgatggctaacaccgctccccactcctgaagcgcggcagataactgcattaccgctgccgtaaaagctggcaggggggcgtcaaaggagccataaacggcaacgaaactctggcagcacgaacagcagcatgccgcaggtgaccgcaatcgccaccagcagaatgaacagaggataacgcagcgccttcgccacctgatgccataactgctgctgccggatctgctgccgggccagttcactgcagcaggtatccagctgaccggtcagttcgcccacctccatcagggccggatagagtgccggaaaaatctgcggccattcgcgtaaagcctgagaaaaaggagcaccgctgagtacccgatgatgcaggacaagcatcagagcacgccagcctgcatgcggatggccctcagccagcaaagccagactctctgccagcggcagtcccgctttgagcagggttgccagctgacgaatcagatcggttttgtgctgccacttccactccctctgacgccacactttttctcgcttccagctcaccggcagaagatcgcgctgcgccagcatcagcagcaggttatcactgtcgatagccagtagctggccactgactaactggccctggctatcgaccgcctgccagcgaaataaagacgcatcagccatcgtccagcccaatcacccgttgcatctcttccagcgaggtatcgccccggcttactgcctccaggccagaaaccagcagggtgcgtaatccctgctgtttcgccaggctgagcaaattctccagcggcatttcggcggcgatcgcattttgcagcctggcattgatcggcagcagttcaaacagcgccagccggccaaaatagccggaaaaacagtggtcgcagccgggagctcgccaggtttgcaaggtaccgggccagagttccgcaggatagtgcgccaccgcctgagcgggctgacggcagtggggacagaggcgtcgaaccaggcgctgagcaacaatcagtttcagcgccgaccccagaagataaccgggaatacccatctgtcgcagccgggtcagggtctcggcggtggagttggtgtgcagcgtcgacagcaccagatgcccggtctgtgccgctttaaccgcaatctccgccgtttcagcatcgcggatctccccgaccatgatcacgtctggatcctgtctcagcagcgcccgcagcacgcggttaaaatcgaggccgtttttagcatggatctgcgtctggttaatgccgggcagcgggatctcaattggatcttcaacgctgcacagatttttttccggggtattcagggcactgagtccgctatagagcgtaaacgtcttgccgctgccggttggcccggtgaccagaatcagcccctgcggctgcgccagcgcggcgcagaaacaggcgcaactgcgcggcgggtaagccgagcttatccagcgacagcgccgcgctttcagtctgcaacagccggaccaccgctttctcaccaccgtagatgggtaaggtggccaggcgaaaagaggcgggtttaccggcgatctccagactgaactgaccatcctgcggtaaccggcgttcggcgatatccagtccgccgaggatcttcagtcgcgccagtagcgcagcaggctgggtgacgggcagggaagatagagggtgcaatacgccatcgatacgcaaacgcacccgcaggccatcacggccgggttcgatatggacatcagaggcgcgacgctccagcgcctgacgcaggatcagctgtgtcgcttcgatcgctgattctgtgggcgcctcttcgcgcgccaccagcggtgtgtcagcgtgctgaagctggtcgagccgggcctgcggccagcattcaatttcaatctgacactggctggcaaaatggagggcttcagccagccctggcggcacgctttccgcgacggcaacacgcagctggctggcatcatggtgcaaaaccagggcacgatagcgctgacataatgccgcgatcgcctcatcaggcttgctcatcgctggctcctttatccgcaaagcggaactgctgcaggcaattgtcgcgcaggctattgttgctgctggtgcagctgcgttgccagctgatgccgccctcggtgctgtcccagagcggcagcatttcaacgctcaggccattcaggctctcctggccggtcagcgtaatgaccccgttggtcacgctcagtgccgagacatagcgcgatcccctggcagcaggaatacccgcttctccggcctgacactgcgtcgggccgccgcgctccatggcgcaaagctcaacagcggttttatagggcaccatggtttgcagcatatcggtaagggcagcacgctgcagataattttgataagcgggcaggccgatggcacttaagattgccacaatacccaccacaatcatcagttcaacaagcgtaaatccacgttgataattcatcacatcgtctccgtattaagaaggcgacaggttaaaaatcgggagcagtgaaagacaggcagagatgggcaaactggaaagcgtgatgtgaacagatttcagacttacagcgcagtcgaaactgcgccggaagcaggctcgcaaaatcgccgtgctgagtgacggcgaggcaggctatttttgtttaaagcgcatcgagagatccagcgcccgcacatgcttggtcagcgcgccaaccgaaacatagtccacgccggtcagggcgatctgtggcagggtagtttcggtgacgttaccggagacctccagcaacgcccgaccctgattaagtttcgacggcggcacgcatcgcttccaggctgaagttatccagcatcacgatatcggcttccgcttccagcgcctgacgtaactcctccagcgattccacctcaacttcaaccggcacatcgggctgcagccattgcgctctttccactgcctgccgaatcgagccgctggcaataatatggttctctttgatgagataagcgtcagagaggcccagccgatggttgctgccaccgccgcacaacacggcatatttcagcgcagtccgcagtccgggcagggttttacgcgtgtccagcagttgcgtctggcttcccgccagcagcgcgacatagcggctgacttcggtagcaacgcctgagagcgtctgcacaaaattaagcgccgttcgctcggcggtcagcagcagccgggcaggcccctcgatttcaaacagcagctggtcagcctcgatctgatcaccatcttcgacatgccagatcagggtcgcgtttgagccgagctgaatgaacacctcttcaacccagcgtttaccacagaaaacaccggcttcgcgggtgatgacctgcgcatcggcctgggtatcggcgggtaacagctgcgcggtgatatcgcggtcagcgtcgatctcgcctccgagatcctcttttaacgccagcgcaacactatccggaatgtcactttcaatgcgtttaatcagagcctgacgacggctgtcgggatcataaccacgggatgacataggcgttttactccagaaagggaaatgacagaggcggtcacaatagcctgaaccgccattcggttccagcaactgataccattttgtttagtatccttaacacgtagtgcgtgaatgtcatcagaccggcacactaagaagcaagaatcctttattattcatgctattctcagccaggtgaaataaggaaaaccgctatgaaaatcaaacagggctggctgacccgcgtgcgtcatgtgccgtcgccgcattgcaacgaaacgccctgataatgaggcaccttcactgctggtgatccacaatatcagcctgccacccggtgaatttggcgggccatggatcgataaactgttcaccggcaccttaccgcccgatgcccatccctattttgcggatatcgccgcgctgaaagtggcggcacactgcctgattcgccgtgacggggagatcgtgcagtatgtcccctttgataaacgcgcctggcatgcaggcatttcgcagttcgaaggacgtgagaactgcaacgacttctccataggcatcgaactggaagggacagacagtgagccttatagcgaggcgcaatatcgggccttgcagcaggtgacgcaattactgctgcaacactatccgttaacgccggcacgtatcacggggcacagtgacatcgcaccggtacgcaaaaccgatcccggacctgcttttgactgggactactacaaacagctgttaacgcagcaaaaatcctgatttttgcggagtcagtatgacgttgtttaccttgttgttggttttaggctgggagcgcctgtttaaactgggcgagcactggcaactcgaacaccggctggagccgatctttcgccagcgccaccatttctcaatgatgcgtaccctgctgatgaccgtgctggcgatggcgctgaccgcgctggtgatctggagtctgaaagggctgctgtttggcgtgctgcaactgctcttctggattgttgccggactgctctgtatcggtgcggggtcggtgcgacagcactaccacagctacctgaaagcggccagtcatgatgacgacgctgcgcatcaggcgatggcggctgaactgacgctgattcatggcgtgccggtggaatgcagcgagcgcgagttcctgcgtgagctgcagaatgccctgatctggataaacttccgtttctaccttgcgccaatgttctggctggtggtaggcggtccgtgggggccggtgctgctggtgggttacgcttttctgcgggcctggcaaggctggctggcaaagcacggaacaccgatggcgcgttcacaatctggcgtggatgccattctgcatcttctcgactggatcccggtgcggctggcgggtgtggcttacgccctgctgggtcatggcgaaaaagcgctgcccgcctggtttgcttcgctgaccgatcggcatcgttctcagtatcaggtgctgacgactctggcgcagttctcactgtcacgcgatccgcacaccgataaagtcgaaacgccacgggttgccgtggcgttagcgaaacgtacctcactggtactggtggtcgctgtcgcgttgctgacgatttacggcacgctggtgtaatcggcaggcggcacgccgaaatcaggcgtgccatcttcccgccagctgaaatatttcagtcgggtatggcggttcggatcccataacggatcgccttcaatttcagtgtagttacgcgcgtggtataccagcacgtcgcgtcccgcctcatcctgggtaaaactgttgtgacccggtccatactgatggttgtcccagctggagacaaataccggccgtgcagatttctgccaggcggcaacatcgagtgggtcggcatcagcagcaatcgacagtatccccagacagtaattctcatcggtggcgctggcagagtaggtcacaaacagccgatccccgtgacgaataaccgccggtccttcattaacgctaaagcctgcgcactcccactcatattctggccggctcagcatcaccggcgtgcctttcagcgtccagggattaagcagctcagccagatagaggttagagttgccgggaatcaatggatctttctgcgcccagagataccagtttttaccctgatgcacgaagtgggtggcatccagtgagaagctgtcaaactggctgaacacccggcgacagggctgccattccccctgcagcggattttccgcctcacacaccagcgcatacatccggtgctgaaacagtccctctttgatttcacgcgtcggtgctgccgcgaaatagatgacccactgtccgtcaatgtagtgcagctcaggtgcccagattaactcgctaaaggggccgctctcgggcttgcgccagacgactaccggctcggcgctgcgcaggccagccagcgtcgtggcgcgacggatctccagccggtcatactctggcaccgatgccacaaagtaatagaactgttcatggcgcaggataaaggggtcggcacgctgctcgataaaaggattcggcaagattgcggtcatttaacatctccggttggcgtgataacaccgtcgcgcaggcgaaacggtgtgtaactcatggaagttttcgcggcgcagcgcgagatcctgctggatggtaatcatcattttgcggtcgaccttcatcagtcgtaccacgcctgcggtaatcagatagccgacgcccgggataatggtgaacagcagcatgatgccgttaattgcctcaggtgactgctgcttagcgcccgcattgtagccatagatcgacagcagaaagccgaccatcgcaccggcaaccgccagtcccaccttgaggaagaacaggttgccggagaagctgatgccggtgatgcgtttgccggttttccattcgccgtagtcatccacatcggccatcagtgaccagtgcagcggagaggggatctgatgcaggatattcagcacaaagtaggcgatcacgaccatcacggtggcgtggggatcgatccagtagaaaccgctggagaagagtgccagcgcgatattggtccagaagaagactttgagtttgcaccagcgatcggtgagcaatttcgccagcgtgctgccgaccatcatgccaatcacacccaggctgataaacagcgtggcgaagtgcgtcgactggcccatgacccaggtcacgtaatacatggtggccgccatacggatgaagccgggacagacgttacagaaggtcagcagcagaatgcgtacccactggtcattcttccagacgtcacgcagatcttttttcaggtcatcattgctcggcacggcagggcggatacgttcacgtaccgtggcaaagcagaacagaaacatcgccaggccaatggttgccagtaccgccatcgccatctgatagccgcgcgctttgtcttcgccaccgaaccactctgccatcggcagcagggacagggagagtatcagcgtagcgatgccgaccatgacaaagcgataagactggcaggagacgcgctcaccgggatcgttggtaatcacgccgcccagagagcagtaaggaatgttaatcgccgtataggtcagcgacatcaggaagtaggtgacgaaggcccagatcaccttgttgtgataggtccagtctggcgtggtgaacatcaaaacgctgaacaccacataaggtacggaaacccacagcagccagggacgaaaacgaccccagcgactctgggtgcgatcggcaatcgcgcccataataggatcggttaccgcatcgagcactctgaccgagagcagcagggtccccaccagcgccggggccaggccgaaaacgtcggtatagaagtagttcaggaacagcatgatggcaccgccaatcatgttgcatccggcatcgcccatgccatatcccagtttttcccgaaacgggagggctgtacctttcatggttttctcctgcgcatccagtgtgaacaggaattattggcaggaaatcagcgagatgaacgggagtaattcgttatgaagatggacaaaacagttgcggggagagaagtgtgaactggatcggggcagttgagacggacagagaggcgcgggtgacgtgctgcaaccccgcaggaggtcgcagcacgaggtaaagcatcaggctttctgtgtctggttcttgataaagtaacccacgcccagaatgaccagccagaccggaatcagccagacagagatcgccatgcccggcgtggtcgccatcagtaccagaatcgccgccaggaaaatcaggcaaatccagttaccggccggatagagcagcgctttaaagcgcgtggttacgccctgcttatctttcttacgacggaacttaaggtgcgccaggctgatcatcgcccagttgatcaccagcgcagagacgaccagcgacatcagcaggccaaacgcttcacccggcatcagatagttgatcagcacacacagcgcagtggcgacagcagagaccagaatcgttaataccggcacaccgcgacggtcgaccttcagcagcgcttttggcgcattaccctgctgtgccagaccaaacagcatacggctgttacagtaaacgcagctgttatagaccgacagcgccgctgtcaggatgaccacgttgagcgcattcgccaccatggcatcgcccagctcgtggaagataaagacaaacgggctgacttctgacgtgacacgcgtccacggcatcagtgacagcagcaccgccagcgaaccaatgtagaaaatcagaatacgccacagcacctggttggtcgcttttggaatgctcacttccgggttatccgcttcagcggcggtgatacctaccagctccagcccaccaaacgagaacatgataatcgccatgaccatcaccagaccgccgatgccatgcgggaaaaatccgccctgttcccacaggttgcgcacggtagcctgcggacccgcgtgtccgctgaacagcaaccagcctccgaacaggatcatgccaatcaccgcaaccactttaacgatggcgaaccagaactccatctcaccaaacactttcacgttggtcaggttgatagcgttaatcatcacgaagaagatggcagccgaagcccaggtcggaaagtctggccaccagaaaactggacatatttgccaacggcggtgagttccgccatggcgaccagcacatagagcacccagtagttccagcctgaggcgaagcctgcaaagttgccccagtatttatacgcgaagtggctgaagctgccggcgaccggctcttccacgaccatttcgcctaactgacgcatgattaaaaaggcaataaaaccggcaatcgcatagcccagaattacggccggtccggcggattcaatgaccgatgcactgcccagaaacaggccggttcccactgcaccacccagcgcgatgagctgaatatggcggttcttgagaccacgtttcagcgcttcgccttgctgttgttccatacaaacctcgtgatgtttttattcttcgttcgcagcgcaggacgctgtaatgaagtagttacaataacgtattgattattttacggtatctggcgtgctgaatagtgccatctgctaccctggcgacaagaatagtgataagcgaatcgctttgcacctgctttcgcctttcgtgctgagagttgactgaaaaaacgccgtcctggtcacgtctgcccacagcaacttctgccatgaaattccgttaatgacgaatagctttcacttatgtctgccgctgcgctaacgcgctaagcgggtgtaaggtttggtaaaagtgaaattatttaacatttgcggtaacgcgaatttttcatttttttaaccgcaagttagcgccagcacaggctttgcgggcaggtgaatgtcgcagacaccatatagacacaaggtgaatactttgttactttaccggcacctctttgcaattggtattaccaatttactccggacgattggcttaataagaagggacgatggcttacagtaagattcgccaacctaaactctccgacgctatcgagcaacagctcgaatcgctgattatggaagggaccctgcgtccgggagagaagctgctgcctgagcgcgaactcgccaaacaattcgatgtctcacgtccgtctctccgcgaagcgatccagcgcttagaagccaaaggattattgctgcgccgacagggtggcggaacgtttcgtgcaggagaatctctggcaaagcttaagcgatccactcgttgagcttctcgccgaccatccggaatcacagtttgatctgctggaaacgcgccatgccttagaaggcatcgccgcctattacgcggcgctgcgcggcacagaggaagacctgctgcgcattcgcgactgccatgtgaatatccagcaggcgcaggacagcggcgatttagacgccgaagcggacgcagtgatgcagtatcagatcgctgtcacagaagcggcccataatgttgtgcttttacatttgctacgctcaatgggccctatgctggaacaaaacgttcgccagaatttcgaattgctctactcgcgccgggaaatgctggcaaaagtgagcggtcaccgcgccagaatctttgaggcgattgtggctcgtgagccagaaaaagcgcgcgaggcttcacaccgtcacctggcgttcatagaggaaatcttgctggacagaagtcgggagcagagccgtcgagaacgctccctgcgtcgtttacagcaacgtaaggaataacgtgcgacaaagatcgtacggacatgtgcgacgagcctgcctgcatctgctttaacaggctcccgattattcaacgtattagacacagataaggaacacacccatgtcagaacgtttacacaatgacgtggatccgattgaaactcgtgactggctacaggcgatcgaatcggtcatccgtgaagaaggtgttgaacgtgcacagtatctgattgatcaggtactgggtgcagcccgcaaaggcggcgtaaacgtggctgcaggatcttctgcaatcagcaactacatcaactctattgccgttgaagatgaacccgattatccgggcaatacctctcttgaacgtcgtatccgttccgcaattcgctggaacgccatcatgtcggtgctgcgcgcatcgaagaaagatctggaactcggcggccacatgtcctccttccagtcttctgcgacgatttatgaagtgtgcttcaaccacttcttccgcgcgcgcagtgagaaggatggcggcgatctggtctatttccagggccacatctctcccggcatctatgcccgtgcgttccttgaaggccgcctgaccgaagaccagatgaataacttccgtcaggaagttgacggtaaaggcctctcttcttatccgcacccgaaattaatgccggaattctggcagtttcccgaccgtatcaatggggctgggtccgctgtcggctatctaccaggcgaagttcctgaagtatctggaacaccgtggactgaaagatacttctgctcagaccgtttacgccttcctgggtgacggtgagatggatgagccagaatctaaaggcgcgatcaccatcgcgacccgtgaaaaactggataacctggtcttcatcatcaactgcaacctgcagcgtctggatggtccggttaccggtaatggcaagatcatcaacgagctggaaggcatctttgccggcgctggctgggaagtgatcaaggtcatctggggcggtcgctgggatgagctgctgcgcaaagataccagcggcaagctgattcagctgatgaacgaaaccgtcgacggcgattaccagaccttcaaatcccgtgatggtgcctatgtgcgtgagcacttctttggtaaatatccggaaaccgccgcgctggttaaagatctgtccgatgatgaaatctgggcattgaaccgtggcggccacgatccgaagaaaatctacgcggcactgaaaaaagcgcaggacaccaaaggcaagccagtactgatcctggcgcataccatcaaaggttatggtatgggcgacaccgcggaaggcaaaaacattgcccaccaggtgaagaagatgaacatggatggcgtgcgctatatccgtgatcgcttcaacgtgccagttgcagatgacaaaattgaatcactgccgtacgtgacctttgaaaagggctctgaagagcacacgtatctgcacggtcagcgtgagaagttaggcggctatctgccaacacgtcagccgaagttcactgaaaagctggaaatgccagcactcgaagagttcagtgcgctgctggatgagcagaacaaagagatctcaaccaccatcgcctttgtacgtgccctgaacgtgatgctgaagaacaagtcgatcaaagatcgcctggttccgatccttgctgatgaagcgcgtacctttggtatggaaggtctgttccgtcagattggtatctacagcccgaacggtcagcagtacaccccgcaggaccgcgagcaggttgcttactacaaagaagacgagaaaggccagattctgcaggaagggatcaacgagctgggcgcaggttcctcctggctggctgcggcgacctcttacagcaccaacaacctgccgatgatcccgttctacatctattactcgatgttcggcttccagcgtatcggcgatctgatgtggctggcgggcgaccaacaggcgcgcggcttcctggtcggcggcacctcaggtcgtactaccctgaacggtgaaggtttgcagcatgaagatggtcacagccacattcagtcgctgactatcccgaactgtatctcctacgatccttcttacgcctatgaagtcgctgtcatcatgcatgacggtctggtgcgtatgtatggcgaagcgcaggagaaacgtttactactacatcaccacgctgaacgaaaactaccatatgccagcaatgcccgctggtgcagaagagggtatccgtaagggtatctacaaactggaaacggtagacggcagcaaaggcaaagtgcagctgctgggctcaggttctatcctgcgtcatgtgcgtgaagctgcgcagatcctggcgaaagattacggtatcggctctgatgtctacagcgtcacctcgttcactgaactggcacgtgatggccaggattgtgagcgctggaacatgctgcatccgacagaagaagcgcgcgtaccttacatcgctcaggtgatgaacgacgcacctgctgtcgcctcaaccgactacatgaaactgttcgctgagcaggttcgtagctatgtcccggccagcgattatcgcgtactgggtaccgatggctttggtcgctctgacagccgtgagaacctgcgtcatcactttgaagttgatgcatcttatgtggtggttgccgcgctgggtgagctggctaaacgcggcgagatcgagaagaaagtggtggccgacgcgatcacccgattcaatatcgatgccgataaagttaacccgcgtctggcttaagaggtaatagagtaatggctatcgaaattaaggtaccggatatcgggtctgacgaagttgaagtcaccgagattctggtgaaagttggcgacaaggtggaagccgagcagtcgctgatcaccgtggaaggcgacaaagcctcaatggaagtgccgtcgccgcaggctggcgtagtgaaagagatcaaaatctctaccggtgacaaagttgagaccggctcactgatcatggtgtttgatgctgaaggcgctgcggaagcagcacctgccgccgccgaagagaaaaaagcggacgcggcgccagcgccagccgctgctgcggccacggccagcaaagaagtggctgtgccggatatcggcggtgacgaagttgaagtcactgagattctggttaaggttggcgacaaagtcgaagccgagcagtcactgattgtggtggaaggcgataaagcgtcgatggaagtcccggctccgtttcgcgggtgtggtcaaagagatcactatttccaccggcgacaaggtcagcaccggttcagccatcatggtctttgaagcagaaggcgcagcaccggcctctgacgcgaagccagaagtgaaagaagaagcggcatcggcacctgccgcggctgcaggcgcaaaagacgttaacgttccggatatcggcggtgatgaagttgaagttaccgagatcctggtcaaagtcggcgacaaagttgaagctgagcagtcactgattgtggttgaaggcgacaaagcctctatggaagtgcctgcgccgtttgcaggtaccgtcaaagagctgaaagtggcgaccggcgataaagtcagcaccggctcactgatcatggtgttcgaagtcgaaggtgctgctccggctgcccctgcggccgcgaaacaggaagctgcaccggctcctgctgccaaatctgaagctaaagccgcggcacccgctccagctaaagcggatagcaaaggtgagttcgcagagaacgacgcttacgttcacgctaccccggtgatccgtcgcctggcgcgcgagttcggtgttaacctggcgaaagtcaaaggcaccggccgtaaaggtcgcattctgaaagaagacgtgcagacttacgtgaaagaggccgtgaaacgcgctgaagcggcaccagctgcagccagcggcggcggtctgccaggcatgctgccatggccgaaagttgatttcagtaagtttggcgaaatcgaagaagttgaactgggtcgtatccagaaaatttctggcgcgaacctgagccgtaactgggtaatgatcccgcacgttacgcatttcgacaaaaccgatatcaccgatctggaagccttccgtaagcagcagaatgctgaagcagagaagcgtaagctggatgtgaagtacaccccggtggtgttcatcatgaaagcggtcgcggcggcgcttgagcagatgccacgcttcaacagctcgctgtctgaagatgcgcagaaactgacgctgaaaaaatatatcaacatcggtgtggcggttgatacgccaaatggcctggtggttccggtctttaaagacgtgaacaagaaaggcatcaccgagctgtctcgtgaactgatggcgatttcgaagaaagcgcgtgacggtaagctgacagcgggcgacatgcagggcggatgtttcaccatctccagcctgggcggcctgggcaccacgcacttcgcgccgatcgtgaacgcgccggaagtcgctatcctgggtgtctctaaatcggcgatggagccggtgtggaacggtaaagagtttactccgcgtctgatgatgccgatttctctctccttcgaccaccgcgtaatcgacggtgctgatggtgcgcgattcatcaccatcatcggcaatatgttgtctgacattcgtcgtttagttatgtaaatgtaaagaaggccggcgtaagccggccttcctgtaacgattcgtcgcgccgcggttggcagtttgttaacaattctgtaaactcttgcggtgaaagtcccggtggaacaagggcattataagaaagtctgacccgccggatatcaattaagaggtcatgatgagtacagagattaaaacccaggtcgtagtacttggggcaggtcctgcaggttactctgcagccttccgttgtgcggatttaggtctggaaaccgtactggtagagcgttacagcaccctgggtggtgtttgtctgaacgtcggttgtatcccatctaaagcgctgctgcacgttgctaaagtgattgaagaggcgaaagcccttgaagagcacggcattgtgtttggccagccatctactgatatcaacaagattcgcagctggaaagagaaggttatcaaccagttgactggcggcctgtcaggaatggcaaaaggtcgtaaagtcaccgtggttaacggccttggcaaattcaccggtgctaacaccctggtggttgaaggagaaggcggcgcgaccaccatcaacttcgataatgccattatcgctgcgggttcacgtccaatcgaactgccattcattccacatgaagatccacgcgtctgggactctaccgatgcgctggaactgaaagaagtgccgaagcgcttgctcgtcatgggcggcggcatcatcggtctggaaatggcgacggtttatcatgcgctgggttcagagattgatgtggttgagatgttcgaccaggttatcccggctgcggataaagacgtggtgaaagtctttaccaagaaaatcagcaagaaatttaacctgatgctggaaaccaaagtgaccgccgttgaagcaaaagacgatggcatttacgtttcaatggaaggtaaaaaagcaccaggcgaagcgcagcgttatgacgcggtgctggtggccatcggtcgtgtgccgaacggtaaaggtctggatgccggtaaagcgggcgtggaagtggacgatcgcggcttcattcgcgtcgacaagcagatgcgcaccaacgtgccacacatctatgctatcggcgacatcgtcggtcagccaatgctggcgcacaaaggcgtgcacgaaggccacgtggcggcagaagtgatctccggtctgaagcactacttcgatccgaaagtgatcccttcaattgcctatactgagccagaagttgcctgggtcggtctgaccgagaaagaagcgaaagagaagggcatcagctacgagacctccaccttcccgtgggcagcctcaggccgtgctatcgcttctgattgtgcagacggtatgaccaaactgattttcgacaaagagacgcaccggattattggtggcgcgattgtcggtactaacggcggcgagctgttaggcgaaatcggtctggcgattgagatgggttgtgatgcggaagatattgcgctgaccatccacgctcacccgaccctgcatgagtcagtcggtctggcggcagaaatcttcgaaggcagcatcaccgatctgcctaacgcgaaagcgaagaagaaataactttctgctactaaagaagaaagctcccgttatgggggcttttttttcgcctggagtttggtgctgtatggcaagaatcgatttgggttaagactaaagttaaccccaataaccctgaaaacgttgcctgtgagagttattagagttatcgtgctttcatcgggacgcgacatgacacagggatggatcgcagcacgttaatttccgaaatgaaggctgatggctgggtttctgacaaggataaacggtagccatcaccatttcacacatccgacaaaaccggggctggttacagtaccccatcctaaaaaagacttaccgatcggtacggtaaagagcatcaggaaacaagcgagaatttaatcccgcttgcccgtagaggtatgaatatgttttatccaatcgcgattgaagcgggtgatcacgaacacgcatacggcgtaatcgttcccgatttaccagggtgtttctctgccggggatactcttgatgaagccattaaaaacgccaaagaggctatcacagggcatatcgaattatgtgtagagctcggtcatgagatccctgccgtgtccaccattgagactctggccacgaatcctgactatcagggttatatctgggcattggttgatgtagatgtcattcgtttgctgggcggctctgaaaaaatcaatgtcactttacccaggtcgttaattgatcggattgatcgttgtgtggcttcacacccggaatacaaaagtcgctcgggctttctggctcaggtagcgcttgagcgtattactgctccgattaacaggcctcaaaagtaagtctgcgcgatagctaaatttattggtggcagaggaatcaaaaggcaccgtttatgagtttttaccccttaagccgttgctatgatctttctcccgtatggtcaggttgatgtctttgatgatgcttttatccagattgataaaaccggcgtaagaatgcatattccggtgaatctggatggactgctgctgattctcttcctgactcttacaaatcagtgagttactgatctttaaatacgtgaatttagtggtgattttttatgagggtaaaatcatcatattttacagccacatacattaagagtgttccccgctttagcggggataaaccacattgatgatggaggtggccagacatctggcctgtgatcccctacgaatgtgaatatcagagtcaggcccgatgaaaaaaaagaacagcactcccacacctcacgatgccactttccggcagtttctctcacagccggacattgcccgcgacttcatggaactgcatctgcccgccgaaactgcgcgctatatgcgacctcagcaccctgaaacttgaatccggttcgttcgttgaagacgatcttcgccagtattttagcgatatcctctacagcctgaagaccagtaacggggatgggtacatacacgtcctggttgagcatcagtctacgccggacaggcatatggcattcaggctgatgcgatacgctgtggcggctatgcaccgccaccttgaagcgggccataagcagctgccgctggttataccggtactgttctataccggcaaacgcagcccttatccgtattcaacacgctggctcgacgaatttgaagacccttcgctggcggaaaacctctatggcagcgcctttccattggtggatgtcacggtgatcccggatgaggaaatcatggggcaccgcagcatggcggcgctgacgctgttacagaagcacatacatcagcgtgacatcgcgactctcaccgatcggctggccacgttactgatggccgattatctttcttcaccccaggtaacagcgctgatacactatttactgcaggcaggcgagtcggctgactccgaagccttcgtgcgcgaactggcacagcgagtgccgcaacacggagacgcacttatgaccatcgcacagcagctggagcagaagggtatcgagaaaggtattcagcttggtgaacagcgtggaatcgagaaaggccgaaatgaaggcaaactcgaggttgcccgcactatgctgcagaacggcatcgaccgtaacaccgtcatgaaaatgaccggtctctcagaagatgaactttcacagatccgtcactgattttgatgtcagaaaacggctcggcaacgtaaagccctgcactacagggcttaacaaatttaatgaaacgcaggcgctgctcatcagtcagtgcgctgacacagtctcccgggttaactgactataattacgagcgtgcttttctgccattcccgaaactcatcacaaagcaattcgactgttatgacaaaattaccggggctcctggcttaaacatcaggataggtggcgctcttgggaggaagcgaagagggctgcagatcagcagggcataaccttcctggatgctaaaattcaggggccggctaaggtctggcttatccctttcactgtttccagtaaacccgataaaacacaatatgggatgctggacggtggcagtctgacattcgaattctcagaagattaggcagcaagctaaccttcatctaaccacgcatctcccatgcagccactcgttcaataaacatctgtgccagggcagtaatggcgctgttgccgggcagtctttcttcattgatatacatcaccagcgaactactgcgtcggcggccctgtaacagcggcagaggacggagctcaccgctttctaactgcgcggtgatattctgttccggcagccagccataacctaactgatgctggaccgcttcaatggctgccgacagcgtcgtgaatgaccagttttctccgcctgatcgccattgacctccgactgctgctgttgctgacgatccagaatggtaatgcagggccagcgtgccagcgtagcagcattaagcggggcggattcgcggtgcagcgggtggtcgcgatgggcgacggcgacgaaatcgacactcatcaggctttcgcctgctaacggcgtgtcaccatattgcgctaccagccagagatcagcctgatgctccgccagtctgtcaggcgtttcgcttcggacgatttcgctaaaccagatgcggacatgcggatagcgttgctgaaaggtctgaagcacatcgaatagcaagggtttgggtagagtcgcatcgaccatcagatcgatgcgcgaacgctcgccgcgttgcagtgcactggcctgcgcctcaagcgcgccgaatccctccagcagcggacgcacctgtgccagcaactgatgtccctctgcactcaggacagcgcggcggccctcctgctgtaatagggtcaaacccagccgctgctgtaacaggctcagctgataactcagtgaggactggctgcgattgttcttctccgctgccagcgcaaaactcccctcattcactactgcgtcgagcagataccactgttcgagtgttgtcttgtacatgataactcatctaaaaattaaatgatttagtgctaaaaatagcgttattaatcggttttgtaacgcgcaataatctcctcaaggaaaacaaatgaggaattaaccatgagcactttcgataaacatgacctgtctggcatcgtcggcaaacatctggtttacacctatgacaacggctggaattacgagctctacattaaaaatgccagcaccatagactatcgcattcacagcggtatggtcggtaatcgctgggttaaaaatcagcatgtctatgtcgtccgtctggcgcaggatgtctataaagtttcctggactgaaccaaccggtaccgatgtcagcctggccgttaatctggctgataaaattttccacggcaccatattcttcccgcgctgggtaatgaataatccggagaaaaccgtctgcttccagaatgatcatctggaagagatggcaaaattccgcgaagcgggtccggcttatccaaccgaagtgattgatgagtttcgcgacgctgaccgtaatccgtgatgtgggcgaaaataacgaaagcgtgatcgactgtccgcctgaccagttgccagcgaattttccggaaaatctgaaaaattaagcatatgcagaagaggtcatgacgacctcttctgaatagcagtttctgtcttgtagcttctgacgtgtaacttgcgagaatgaaaaagagatttaccgaccagggttttatcagtagtaatcagcaggacgaattcggtttcagttgcatcaggctgatttccggcctggtgttgttatcctcctgagctcacctccgctgtaccccataaacacgccggcttctattcctgccagttatctatttccctgaatcacttcgctaaagccacggcaaaactgacataaacctgcagccatttgtgtggaatgcggtacgctgcagagagacccattcagccgactcagctggctgatgcagggagttaagcgggcagagtggccgtagtggattatgttgtatttttgtaaacagattaacaaacagacgaaatactgctattctgccctccgcgaaaccgggcacctcaacctggacgagaaggggaagattgttctccataagtgagcaaggtggtcggaaagccctacataatgagagcgaggataacgtcgtgctagaagaataccgtaagcacgttgccgagcgtgctgcccagggaattgtacctaagcctttagaggcttcccaaatggccgcgctggttgaactgctaaaaaatccacctgcgggtgaagaagaatttttgatcgatttattggtcaaccgcgtcccacctggcgtcgatgaagcggcgtatgtcaaagccggtttcctggcggctgtcgccaaaggcgaagcaacctctcctctgatatctcctgaaaaagcggttgaactgcttggcaccatgcagggcggttacaatattcatccgctgattgaggcgctggacaatagcaaactggctccgattgccgcgaaagccctttcacacacgctgctgatgttcgacaacttctatgatgtcgaagagaaagcgaaagcgggtaatgaatacgcgaagcaggtgatgcaatcctgggcagatgcggaatggtatctgtcacggcctgaactggcagagaagatcacggttacagtgtttaaagtcactggcgaaaccaacaccgacgatctctctccggcccaggatgcctggtcacgtccagacattcctctgcacgccctggcgatgctgaaaaatgcccgtgaaggcattgagcctgatgaagtgggcaatatcggcccgatcaaacagatcgaagctctgaagaccaaaggcttcccgctggcgtatgtcggtgatgttgtcggaaccggttcttcacgtaaatccgccaccaactcggtgctgtggtttatgggcgacgacatcccgaacgtgccaaataaaaaaggcggcggcgtggtgctgggcagcaaaattgcacccatcttcttcaacaccatggaagatgcgggcgcactgcccattgaagtagacgtaaacaacctgaacatgggcgatgtgatcgacatctatccattcaaaggcgaagtccgcaaccacgaaaccaatgaactgctggccagcttcgagctcaaaaccgaagtagtaattgacgaagtgcgcgccggtggccgtattccgctgatcatcggtcgcggcctgaccaccaaagcgcgcgagtcgctgggtctgccacacagcaccgtattccgtcaggcgaaagatgtcgcggagagcacccgtggtttctcgctggcgcagaaaatggttggccgcgcctgtggcgtaaccggtgttcgtccgggtgcctattgcgaacctaagatgacctcggttggctcgcaggataccaccggcccgatgacccgtgacgagctgaaagatctggcttgcctgggcttctcgaccgatctggtgatgcagtcgtttctgtcacaccgccgcgtatcctaagccggtggatgtgagcacgcaccatacgctgccagacttcatcatgaaccgcggtggtgtgtcactgcgtccgggtgacggcattatccacagctggctgaaccgtatgctgctgccggataccgtcggtaccggtggtgactcgcacacccgtttccctatcggcatctctttcccggcgggttcaggcctggtggcgtttgccgccgcgactggcgtaatgccgctcgacatgccggaatcggttctggtgcgctttaaaggtaagatggagccgggcattaccctgcgcgatctggttcacgccattccgctgtatgccatcaaacagggtctgctgaccgttgagaagaaaggtaagaaaaacatcttctctggtcgcatcctggagattgaaggtctgccggatctgaaagtcgagcaggcgtttgagctgtccgatgcgtcagcagaacgttccgctgcgggctgtaccatcaagctggataaagcgccgattatcgaatacctcagctccaacatcgtgctgctgaagtggatgatcgcagaaggctacggcgatcgtcgtacgctggagcgtcgcattgaaggtatggagaaatggctggccgatcctcagttgcttgagccggatgccgatgctgaatatgccgccgtgatcgaaatcgatctggctgaaatcaaagagccaatcctctgtgcgccaaacgatccggacgatgcacgtctgctttctgacgttcagggtgagaagatcgacgaagtgtttatcggctcatgcatgaccaacattggtcacttccgtgctgcgggtaaactgctggatagccacaaaggccagctgccaacccgtctgtgggtggcaccgccaaccaagatggatgcggcacagctgaccgaagaaggctactacagcgtattcggcaaaagcggtgcgcgtatcgagatcccaggctgttcactctgcatgggtaaccaggcacgtgttgcagatggttcgacggtggtttcgacttcgacccgtaacttcccgaaccgtctgggtaacggcgctaacgtctacctggcgtcagcggagctggctgcggtcgcgtctctgcttggcaaactgccaacgccagatgagtatcagcaattcatggcgcaggtcgataaaacggccagcgacacgtatcgctatctcaacttcgaccagctgacgcagtacaccgacaaagctgatggcgtgattttccagactgcggtctgattcttcaccttgcaggcatgaataaggggcgatgattcgcccctttttttcgtctcagcatggggtagagagacgatcaaaagctggctttcggcagacagcctgtaataatgcgcgacgtgtcacactttgccgcgagagcagcacggacacttaccaggtgagacgacgacgttgagaggaacgggcgatggaatatgaatttttacgcgatgtgaccggacagattaaggttcgcatgtcgatggatcatgaagcggtcggccactggttcaacgaagaggtcaaaaacgatccgggattgctggatgaagttgaagccgccattgaagatgtcaaaggcagcgtacgtcagtggcagcggatcggcagcgagtacaccattctgctggatgaagaggaggtgatgatccgcgccaacctgctggctctggaagatgacggtatggaagaggggatgaactactacgacgaagagagcctctcgttctgcggcattgaagattttcagctggtgatcgctgcttatcgccagtttatgaaccagtacggcaaacccgtacggtaatacagaaaggcaatcttttacggttataaggccgggcgaactcagcagcccggcctgttaactaactcagtgatgcaccaccgcacattaccagctgctggccggtgatcgccgccgccgcaggggagagcaggaaatcgaccagcccggccacttcctgcggctgaatatagcggccaatgggtggcagacggggcggtgaactggcacggcccggctgttgcagcatcggcgtttcggtggcgcctggcgccacaatattggcggtaatgccgcgcggagcgagttccgccgcccagctgcgcaccataccgatcatcgccgatttggtggcgacatactgactgcggcccgccgcaccgcctgatgtccggctgcccagcagcacaattctgccgcccacacgcatccgcggtgcaaaatgattcgccagctgctcagcagcggcaacgtgcagttgccataagcgtgcgctggcgttcagatccagctccccaagcggcgcggcctgcatcataccggctgcatggattaccgcctgcggcaccggtagcgcgtccagtaaagcctgcagtgccgcgctgtcgctgatatcgatttgatggctctgccagcccgcttctgcccggcttatcgccgagcgactcaggccgataacctgccagccctcatcgagtaaacggtcagcaatcgcctgaccgatgccggagctggccccggtcaccagcgccatccgttcaatcacgcatcacctcccttcacccatgactccgcgacccgcacatacttaatcgcctgacgataccaggtgtaggcgatatgcagttcgccatccaggccctgtttaatgctgggataagagaactcacggtttaatttctgctgggagttattggtcatgcagtagccatcgccctcgtccagattgcgctgcagcggccagcttttaccgccatccgtggagatagccagcgtcatcggcgcacgaggcgcaccccagaaagcggtgcgaccactgtgcaccaccggctcagcggcgacggcaacatcactttcctcttcatcgtcttcaatttcgtcatacagcgacaaccggcgtttcgctggcaccttcggcgctcatggcattgaacaccagcgccagatgaccattgcgcagcgtcgtgacctgaattgaggagttattgttgggcagcgacaacggctgtggcgcgctccagctttcaccctgatcaagtgagcggctctgatagatgtggtcggcccagcggctgcggtagagcgccagcagcgagccatcatccagcagggttacgttcatatggacgcagccggtgctgtcaggcacgctgacgtcgcgccagctctggcctttatcttctgagatttttaccgcgctcacgtcatagctgccgacccacttttcgccaggctgcgtcaggcagtaaaacaccggcagcaaccagttaccgttgggcagcaccacaatcggctggcgaataaaggtgccaggcttatccagcagcgttttgatctccccccagctctggcccagatcgtgagactggcgatagcgaacaatcgcggtgtcctgattgcccgatttctgcgccgtccacagcagccacagtacctggtcgggatcgagaaacagcaccggattctgttctgaacggcccggatcgtcagagagtttttgtgcttcactccagcgatcgctgccttttcgcagccgtgaacaccagacagagatatcggcaatcccttcctgcgtgccgccaaaccagacgcaaagcagatcgccatcgggcagcggcagcaggttagccgcgtggttttgcgggcaggaggagggcagcatcgcaacctgctgcgcgctatcctgcgggtgaggcgcaagcaggccggtgcgttctgcggtgacggtttcctgagtcattttaggctccactgttttgtgcattgtgttgcgattgaggctgagactggcgtgacgggatacagcggtcaatcaccataataattgccggggtgatcagcgccacgtacatattgtcgataccaaacgggttacccatcaggaaccagacggaagtgacaacgcaggcgccaatcagaccggcattggcgccgcgtgtgctcttaaaccacggcaggtagaacgccatgatcgccacaacggtaatcgacagacgaatcgcacgggtaaagaacgagagcttcagcacttccgggaagaacagaacaaacagcagcgggaagaagccgatgccaatcgagatccagcgtgtcattttaaattcgcgctctggcgtaggattacgataaggcacgtaaaagtctttcaccaccagcgaggcgatggccagcgccacggtaccgacgctgacgaaaatcgaggccaccagcgaggtggtgacaatgcccgccagccacggtgacatatcctgcagaaacaccggcagcgcatagaggctcttgatatccgggtgagcaaacttcgctgccacgccaatcagcgccatcgccagaccaatcggcaggcagaagaagaaggcgacccaggtggcgcgcttcgctgacttcacatctttggtggaggagatcgcctgaatcacaaactgggtacagaagatcgaacctacggtcccgatcagccaggccacaatggtactggcaccgacgtgaccatcccatgtccagtagaaacgccggcattttttccatcatcggggcgacgccgccggtcatcttcagcgccacatagaggataatcaggatccccatatacttgatggcgctgtgcagcagcgtgacccaggccacgcctttcatgccgccaaatgcaaagtagaaggtgctgaccaccgcagtgataaaagccgcctgggtcaggtcgatcttgagtacggtggagatcgccgccgcgccgctgatgtagttaccgacgttcaccagcaacagcgcatagatcatgatcagcgaaataatatttttggtcgaactgccatatttctcggcgatagcaccggaaatagtgatctttccggtgttgtagatgcgtttgaccagtatcaggccaaacagcgggaagccaattgccgcgccaatcaccgaccatgaggcggcgaagccatcttcaaaggccgcctgcgcggtgccgatggtggattttgccccgatatattcagacatcagcataatgccgacgataaaagcaggcatggcgcgcgagccttccataaagtcgccgctggttttactgcgcagccgccaggtgagccaggtggtgaacaggatataggcgaccaccatgccgacgatcagtaaggtgctctcagttgaaaatgctttcatcatgacctcgattgttctggcagatggcgaccatcaggttcgttctcatctgaccggtagggtgcaaaggtgatggacgttattgcaggtagtggttcacgatttgacggatctgctgctgctcttcggcgctgaaactgcaccgcatagcggctttcacccacctcaaagccctgcaggctgaccgcttttttcacggcggccggtgagaaaccgatgctgtacagtgcggtgcgcaggccggtgacgttctcctgtgcctgatgcgaaccggcaatatctcccgcatggaagcgcgcccagatggcgttaatcgcctccggtgccacgtttgccagcccggaaattgaggcggagcagccatccacaaaaccctggtggatcagcgaatccgggccgttcagcacagcaaagtcctgacagtcggcggtagcctgcagaaagccgctcagactttcatagctgcctgctgaatctttaatgccgatgatgttcgggtgcgcggccagcgtacgaacggtctctggctgcaaggtattgccggtacgcgccgggatgttgtagaggaacagcggcaccgtaagcgcatcagccacgcgctgatagtggtcgatcagctcctgctgcttaagcggaacaaaccacggcgtgatcgcggaaacagcatctacgccaaggcgggcaatctgtttgccgagccggatagtttcacgggtcgaaatctccccgatatgcgccaccaccgatgcccggccgttaacttcatcgacgcaggtggtggtaaccgcgatcttctcctgctcgttcagcacaaagaattcgccgttggttccgccacagaagatgccgttaccggcgttgatctggcgtctgacctgttcgcgctgcctttctggatcaaaggcaccttcccggtcaaaagtggtgacgatggcggtcagtacgccgtttattttcttattcatgacaatcctcattacgcctggcaggaagggaaaagcgtcaggtagacggcgcgcacatcgtcggcggtgaccgccatcggcacgttgttcatcagacgctggacgtcgagcgcggcttccactaaccagggcaggtgatccgggctgatgcccagtgcttccaggctggcaggcagttgcagccgcgccaccagcgcggtgaagtagtcgaccagcgcgtgtgatttctcttcatcgcttaaacggacgtcggcgtcgggcagcagatcataggcctgagcgaatttgctcaccgccgccggacggacaaagcgcatgcagggagccagcaggatggcgttggcaacgccgtgtggcagatgatatctgccgccgagcgggtaagagagggcatgcaccagatgtgtcccggcatgggcaatcgatgcaccgccataataagaggcccagagcatctccaggcgtgcctgcaaattttctggctcgcgcagggtggtttcgagattagcgaacagtttcttcatcccaatcagcgcatagttgtcgctgaccgggttggcgacattggcggtaaagcactcaatcagatggcagagggcgtcaataccggttgaagaggcaatatgtggcggcatgctggtggtcagtttccggcaccagggccaccacatcgggcagcatcaccggtgaaataatgccgactttggtctctttctccgggatcgccaggatcgcattgggcgtcgcctcagaacccgtgcctgcggtggtagggatcagtattgaacgggtacggcgctgcggtttttcgcctgccagcagggcgtccagcgaaggcgcggcgtcgatgcacagcactgagagtagcttcgtcacatccagcacgctgccgccgccgatgccaatcaccatatcgacctggagccgggagagcgtcgcgataatcgctgccacatcatgctggcttggttcaggcggaacgctgttgaccacgctgatacccggaatctgatcccgaagttgacccatcagcgcctgcactgccggaatcgcctcaatgttccggtcagtgaccacgactgctgtcgatatccccttcagcagatagcgcatgtcgtttaacgcctgataaccgctaatcaccgtgctgttaatgttcatttcatacccttatttctgtcctgtctgagcagatgattaatcttgctcagcgcaatgcgaagtcagtcactctcagtggctaattttataaggcatatcgatttcgattaatttgaacttgctcacatataatcaatcatgattgaatataatcaaatgcggtggcaatcgcctgacaggagtgaggatgggctcatcattatggaaaaccccggtgctggtcatcgccgatgactttaccggtgccaacgatgcgggtagcggactggcacaggctggcgcccgcgtacatgtgctgtttggcacggaggcgccgttgccagaggacgctgcggatgtgctggttatcagcaccgacagccgggcagtcagcgccagccaggccgcagagcgcgtcgctcaggtggtgcagcacttcgccgcacagcttcggcagggctggctgtttaaaaagatcgactccacgctgcgcggcaacgtcggtgctgaaaccgcggctgcgctgcgagccagcggcaaaaggctggcgctggttgcgccggccgtgccacgactgggccgcaccacacgcgaaggtaaagtgtgggtcaatcagcggttactgacagacaccgaatttgccagcgatcctaaaaccccgatcctcagcgcccgcgtactcgatcagatgcagatcgacggcacggagatcgatctcccgacgctgcgcagcgatcggcttgatgcggtgttagcggcggcgcacggcgtggtggtggtggatgccgaaaatgaagccgatctggcgcgactgataatcgctgcggcgcggctgacagagaagccgctgctggtgggcgccgccggattaagcgatgcgctgggcacagcgctctctgttcgcccgtcgcggcccgtgctggcggtagtgggatcgatgagcagcagcgcgcagcagcagatcgccacgctgcttaaccagcgggcagttgagatcgtggatgtcgatatccgtcagctgtttcagcagcccgcctggcctgaccgggatcgctggatcgaacaggctgccgccgcactgcgtgccggtcgccatacggtgatccgcacctgccagcatgaatcccagcgtcacgacattgagcatctcagccagcagcacagcgtgacccgccagcagctgggcgaagcgatcagtctgttgctgggcgaaatgactcacagcctgtgccggacacagctgccgcatgcgctctatctgtcgggaggcgacgtggcgattgccgttgcccaggcactgggggccagcggctttaaaattcagggtctggtggcgggctgtgtgccgcacggggttctgcttaacagtgaatttactctgccggtgatgaccaaagcgggtggctttggtgatgaaaataccctggtagcagccattggttttattgaggagaagtcgagtgagtaaaattattgcgatcaccatgggcgatccggcgggcatcagcccggaaatcatcattaagtcactctctgaaggtgagctgaatggcatcccggcggtggtgattggctgtgccagtacgctgcgccgcattatggcaatgaacattacgccacaggccgagctgcgggtgctggatcgggtgcaggatgcccggtttgcgcccggcattatcaacgtcatcgatgagcctctggccgatcccgacgcgctgaaacctggcgtggtgcagaaagaggcgggagatctggcgtggcgttgcgtgaagcgtgctacagagctggcactggcgggcgacgtgcatgccatagccaccgcgccgctgaacaaagaggcgctgcatgcggcgggccatctctatcctggtcacaccgaattgctggcgcatcttaccgggaccaaagattacgccatggtcctctacaccgataagctgaaagtgattcatgtcacgacccacattgcgctgcgtaagttcctggacacgctgaaccagacgcgcatcaaaaccgtgattggtatggcggacactttcctgcgtcgtgtcggttacagcgccccgcgtatcgccgtggcgggcgtaaatccgcacgccggagagaacggcctgtttggcgatgaggagatcaccaccgtggcacccgctattgaggcgatgaaagcgcaggggattgatgtctacgggccttgtccgccggacacggtgttcctgcagtgccaggatggacggtatgacatggtggtggcgatgtaccacgatcaggggcatattccgcttaaactgctgggcttttatgatggcgtcaacatcaccgcaggcctgccgtttatccgtacctctgctgaccatggcaccgcatttgatatcgcctggacaggtaaagcgaagtctgacagcatggcgatctctattaaactcgcgatgcagctcgcatagggatatatgaagggacagagccgtcttgaccagattatggattacctgaaaagccataatctggtgactgttgagcaactggtcagtgcgatttccgcctcacccgccacgattcgccgtgatttgattaagctggataaagagggcgtgatcagccgcagtcatggcggcgttaccctgaatcgttttattcctgcccagccgaccacgctggagaagatgcagcgtaacctggccgagaagcaggccattgcagaatgtgccgccagctttgtccgggcgggcgatgcggtcgtgctggatgcgggcaccaccatgctggagctggcgcggcagctcacgcatctgccgctgcgggtgatcactgccgatctgcacattgcactgtttttgtctgagtttaagcagatcgaagtgacgattatcggcggacgtatcgacgactccagtcagtcctgtgtaggcgaacatggacggcggttgctgcgcagcatcaatcctgatatcgcctttgtcagctgtaactcctggagccttgagcgcggcattaccacgccgactgaggagaaagcggggctgaaacacgatcttctggccaatgcggctcgccgggtcttgctggcggacagcagtaaatatggctcctggtcgctattctgcgcttctccggtggatgacctgacggatgtggtgaccgatagccggttagaggaggctgtctgccgcacgctgcgcgagcgcgggattacgctggcgctgacctccgcctgaacagaatgcgccgtgttgctctgacctgatcagcaggacgagagcagcaccgcgcgtttatctttatctctcgccgttaaaacgcgccgttaacgcgcgtacgcatcattctcttcgcgcgtagtcacgggtgcgtccaccgaaacccgttcaaacctcagtcaggcggttgccgtgatgaaaaagcagaagtaacaagagggaaggagacgcgcaggttatgatctataacgctgcgcgcctgataatcagagggtcttcaggcccactgaggggatatttctgccgtagtagatctcgcgcatctctttccagagcagatcggtaatgcgcttgtgctcctgcggagtgagatcttccgggcgggtgttaaacaggtagtgtttaaggtcgaactctttcagcaacatcttggtatggaagatgttttcctgatagacattcacatccaccatgtcatacatcgctttcatatcttcagacatgaagttctgaatcgaattgatctcgtgatcgatgaagtgcttcatccctttcacgtcacgggtaaaaccgcgcacccggtaatcgacggtgacaatatctgactccagctggtggatcagatagttcagcgcttttagtggcgaaatgacgccacaggtggagacttcaatgtccgcacggaaggtgcacaggccgcctgccggatggctctccggataggtgtgcacgcagatatgacttttatcgagatgagccaccaccgagttgggcagcggaccggggtgctctgagttatcgatatctttcggatcgatcggctcttcgctgaccagaatcgtgacgctggccccctgcggctcataatcctggcgcgcaatgttgagcacgttagccccgataatggagcaggtctcagtcagaatttccgtcagacggttagcgttatattgttcgtcaatgtaggcgatgtaaccatcgcgttcagcttcagtattcgcatagcaaatatcgtaaatacaaaaactcaggcttttcgtcaggttgttgaagccatgtagttttagcttttgcaatttcgttcacccccttagaaatgcactatcagcacgcggcggataacgcattcaacagatattgcggcagggcaaagctgccggtatggattgctggcgtgtaataacggcaggtcaggccagcggcctcgaaacgcgcctttaaagtcgcggtgtcgagctggcgcagcgccggattatcactcgcccaggcaaaggtcataatgccgccgtagtaggtcggaatcgccgcctgatagaaactgacgtccgcaaagtaatgtcccagcttgcgatggctgttaacggcctcatcctgctgcaggaagcagacgccattctgcgccacaaagatgccattttcattaagggccgctttgcacccggcataaaattccgaggtaaacagactctcgcccggaccaatcggatcggtgcagtcggagataatgacatcaaacttttcctgcgtctgattaacgaagttcaccccgtcatcaatcaccagcgtaaagcgcggatcgtcataggcacccgcgctgtggttcggcagatactggcggcaaaaggtcaccacgcccgcatcgatctccaccatggtaatcttttcgatcccgggatgacgtgacacttcacgcagcattgcgccgtcaccgccaccgataatcagaacgctcttcgccgcgccgtgcgccagcagcggaacgtgggtcatcatttcatggtagataaattcgtcgcgtttcggtggtctgaacgacgccgtccagcgccattacgcggcccatcgcggcattttcgaaaatgattaaatcctgatgcgcagtcttctcacggtacagctctttatcgaccgtgaaatactggccaaaaccggcatgaagggtttcataccacgtttcattgtgggccatggtgctctcctctgatgacatcgccatgaagatgggcggcatatgatagctaacactgaccgtggttgcacggtcaatgtccggctgcagagggaagaatcgttacctgacgtaggccagcaggctcagcgaatcgcgggccagtgacttgcactttttgtcgttggtgatggcgatgccgctgagatcgcgatagctatcttcacccagcgctttcatgttgtagttgctgtagttgcttaaatcccagcggttctgctgagcaaaaaagaccagcgctttgcgaatctgcgcgtccggtaaatcctgatagccacaatcatttttcagatagacgaaaaccgccgtgagatcggccagatcttccgcttcggattcgctcagggcaaaactggtggaggagaagccaaggagtcccgtcagcagcaggatcctgatactttgcttcatagtcattctcttcaatggatattgctaatgacgttagcacagttgctctcaggttttcgattaatttgccgctgtgggctgctgcaccgccttttttcgtcagattcgcacgggtaagacttgaccttcccataaggtcagggtttaggctgtgcgctctgatgccacaaggatgatcaccatgcaacgtcgccatttcctgaaactcactgccgcactgagtgcagccggagcattaccgctctggagccgttcgctgatggcagccagccgtccgctgctgccgattccgtctctgctggaacccgatgccaggggcagctacagcctcaccgcgatgcagggtaccacccagtggaacggcaaagcggtgccgacctggggctataacggcagcctgctggggccggtgctgaagatgcagagtggcaaaccggtgacggtgaacattcataaccggctcagcgaagcgaccacactgcactggcacgggctggaaatccccggtgcagtggatggcggcccgcaggcggtgattgcgcctggcggctcgcgtcaggtctcttttacgcccgatcaacccgccgcaacctgctggtatcacccgcatctgcatggcaaaaccgggcatcaggtggctcaggggctggcgggactgatcctgctggaagataaagagagcggaacgctgcgattgccctcgcagtggggtgtggatgatgtgccgctgatttttcaggataagcaactgaccaaagatggcagccgcattgattatcagctcgacgtgatgcgcgccgcggtgggctggtttggcgacatgatgctgaccaacggcatgcactatccgcagcatgcggtgccgcgcggctggctgcgtctgcgcctgctcaacggctgcaatgcccgttcgctgcatgttgccgccagtgataaacgtcctctctacgtgatcgccagcgatggtggcctgctggccgagccggtaaagctcgactcgctgccgatcctgccgggcgagcgttttgaggtgatgatcgatacttctgacggtaacagcttcgatctggtgacgctgccgacagagcagatgggcatgacgctgccgccgtttgaccagccgctgccgctggtgcagatcctgccgctgcgggtgatggccagcgccacgctgccggatcagctggcgacgctgccagcgctaccctcaaccgacggcctgacgacacgctggctgcagttgatgatggacccgcagctggaccagcagggcatgcaggcgctgatgcagcgctacggcgagaaagcgatgggcaagggcggtcatcacacgatgtcgcagacgccggaggagaaaacgacggcagagccgatgccgcctatggaaagcatggatcacagcatgcacggcaatacgccgcccgccggttacgatttccgcaacggcaataagattaatggccaggcctttgatatgacgaagccgtcgtttgcggtgaagctgggtgattacgagaagtggacgatttcaggtgaaggcgatgcgatgctgcacccgttccacattcacggcacccagttccgtattctttcagaaaacggcaaaccgccagccccgcaccggcagggctggaaagatatggtgaatgtcgacggctggcgcagtgaagtgctggtacgcttcaactatgtcgccgccgcagaacacgcttacatggcccactgccatctgctggagcatgaagacaccggcatgatgctgggttttaccgtcagctgattacgcctgctccagcgccagcttcacatcttcaatcaggtcgccggcgttttcgatgccaatcgacagccgcaccgtggcgtcagtgatcccaatacgctgacgcaccgcctgcggtacgccggagtgggtggtgctgccaggatggctggccagcgactcggtcccgcccaggcttaccgcctgcttaaacagcgacagcgcattaagaaaacggaacgcagcgggctgatcgccgacgatatcaaatgagaaggtcgaaccggcaccgctgcactgctcgcgataggttttcccttcggcgctctccgcatccagatagggcagccagtgcagcttcgccactttcgggtgatcgcgcagaaacgccgcgaccgcttccgcattctgccaggctttctccatgcgtagcgacagcgtttccagcgagcggctgagcatccagctggagtgtggatccagctgcgtgccgattgcgctgcgcagggcgcgcactttcgccatcagcgctttactgcccatcgccgcgcctgcaatcaggtcagagtgaccgcccacatacttggtcagcgagtagagcgacaggtcagcgcccagcgttagcggctgctggaacagcgggccgagcagcgtgttgtcacaggcgataatcggtcgtgaaccctgctgctgatcaatctcatcagcgatacgcgccatcagacggatattgaccaggctgttggtgggattcgctggcgtttcaatcaggatcaccgctacccggccctgggccatcgcctgctgagcggcttcacgcactttgacttcatcattgccgtcgctgaaacccaccgctttgatgtccagattgtgcagcgtcttgctaagcagggtttcggtgccgccatacagcggctgggaatgcaggatcacctcgcccggacgggcaaacgtcagcagggcagtggagatggcggccataccggaagagaagagcgaacagctctccgcctgctcatagaccgccagccgatcttctacaatttcgctgttagggtggttaaagcgggaatagaccagcccacccgatttgccttccggcggctcacgtcggccagagacgtaatcaaagaaatcccgtccctcttcggcgctgtcaaagacaaaggttgatgtcagaaacaccggcggcttcaccgcaccctcagagaggcggggatcatagccatagttcagcatctgggtttcagggtgcagcggcctgtcgccgatatgcgtttttttgcttgaagatgaagtcattgtgatctccggccagcggcgcgagtagggtaacgatctgttggataaaggctaccatgcagcgaatcatgctggtaaatgccagaatgttctaaggtaatgcgcatttcagcgagccgcaggcggcgggtaataattttcgcgacgtaatcgtttgcttatggggccgcgcagccgtcgctgctgcgtctgtgatagactccggggcttttctgacgtaaccgggctgaacgcaatgaaacacactgttgaagtgatgatccctgaacaggcaatcgccacgcgcatcgctgaactgggcaaagagattaacgaccactaccgcgacagcggcagcgatatggtgctggtggggctgctgcgcggctcctttatgttcatggctgatctctgtcgcgccatcgatgtgccgcatgaagtcgactttatgacggcttccagttacggcagcgggatgtccagcacgcgtgatgtgaaaatcctgaaagatctggatgaagacattcgtggcaaggatgtgctaatcgtcgaagatatcatcgactccggcaacaccctgagcaaagtgcgtgagattctgcagctgcgtcagccaaaatctctggcgatctgtaccctgctggataagccagagcgccgtgaagttgaagtgaacgtcgaatatgtcggctttgcgattccggatgagttcgtggtgggctttggtatcgactatgctcagcactatcgccatctgccttatattggcaaagtggtgccgctggaatcctgataccgctctaccgcacattcttccaaggcctgcacctgttgcctggtgtaggctatgccgcgctttacgctgcgatcggctcaggcctcgccgttcttccgcagattagcaatgccgtggcggtagcgctgttcgaggatctcccggctgtttgccgtcacatcaaggttacgcagacagccgtcctgaatgccgtatacccagccgtgcagggagacatcctttccgcgtttccaggcagattgcagtacggtggagtgccccaggttatagacttgttcaataacgttgatttcgcacagtttgtccaggcgcttatccggcgggagttcccccagcaacacgctatgcttgtaccagaggtcgcggatgtgcagcagccagttgtcgattaatcccagttccgggttatccatcgccgcctgcacgccgccgcagccgtaatggccgcagacgataacgtgttccacttccagcacttcgatagcgtactgcaccacggacagacagttcaggtcggtgtggatcaccagattggccacgttgcggtgaacaaagagttcgccgggttccagtccggtcagacgtttcggcaggaacacggctgtcagaacagccaatccacaggaagcgcggtttttgtgcctgggcgagccgctcaaaaaagctgggatcttcttcaaccagtaattttgaccattcgcggttgtttctgatcagggtgttgatgtctgtcatggtgttgagcgaccggttactgcgcagagtgcgcgcgcgtactatatgacagggcctgataaatttaaacggcattgcaatgccatcaaaacagggtatggatgcagaatgacttatgcactggaactttcccggctgaccaagacctatcccggcggcgtgcaggcgctgaagggcatcgatcttaacgttgaagcgggtgacttttatgcgctgctggggccaaacggtgccggtaaatcgaccaccatcggaattatcagttcgctggttaacaaatccgagggcagcgtgcgggtgtttggctacgatctcgaaaaagatgtggtgaatgccaagcgccagctcggcctggtgccgcaggagtttaacttcaacccgtttgagacggtgatgcaaatcgtcgttaatcaggcgggttactatggcgttgagcgtcgtgaagccaatgagcgggcagaaaagtatctgaagcagctcgatctgtggggaaaacgcgctgaacgtgcacgcatgctttccggcggaatgaagcgtcgcctgatgatcgcccgtgcgctgatgcatgagcctaagctgctgattctggatgaacccactgctggcgtggatatcgaactgcgacgctcgatgtgggtgttcctgaaagatctcaatgccaaaggcacgaccattattctcactacccactatctggaagaggcggagatgctgtgccgcaacatcggtatcatccagagcggtgagctggtggagaacacctcaatgaaagggctgctctccaagctcaaatcagaaacctttatcctggatctggcaccccgcagtccgctgcccacgctggaagggttccagtaccggctgaccgatacctcaacgctcgaagtggaagtgctgcgtgagcaggggctcaacagcgtcttcagccagcttagcgcgcagggtgtgcaggtgctgagtatgcgcaataaagccaaccgtcttgaagagctgtttgtgggtctgacgacgcagggaaaaacaggagcaaaagcatgacacatctctactgggtggcgctgaagagcatctgggccaaagaggttaaccgtttcgcccgcatctggatccagacgctggtgccgccggtcatcaccatgacgctctatttcatcatttttggtaacctgatcgggtcgcgcatcggtgaaatgcacggcttcagctatatgcagttcatcgtgccgggattgatcatgatggcggtcatcactaacgcctatgccaacgtggcgtcgtcgttcttcagcgccaagttccagcgcaacattgaagagctgctggtcgcgccggtgccgacccacatcattattgccggctatgttggcggcggcgtggcgcgtggtgtctgcgtgggtattctggtgacggccatctcgctgttctttgtgccgtttccacgtgcattcctggacgatggtggcggtcacgctgctgctgaccgcgattctgttttcactggcaggtctgctgaacgctgtttttgcgcgcacctttgacgatatcagcctgatcccgacctttgtgctgacgccactgacttatctgggcggcgtattctattcactgagtttgctgccgccgatctggcaggctgtctctaaacttaatccaatcgtttatatgattagcggattccgttatggcttcctcggcattaatgatgtgccgctggtgtttaccctttcggtgctggtggcctttattctggtgttctactggctggtctatgcgctgatacagcgcggacgcggattacgcacctgacgttaagctgaatggtaagggccacgctgcgataagggcgtggcttttttttgggcggagagcaaatcacgctgactacggttctgcctggccttaaaaatcaccttaaaacccgcctcattcgttatattttgcctctgaagccgcctgacgcctcgcttacatccttactcacaaaaaataaccctaagtattatctgataatactctgacatctttcgctatctgaatgattcttaactattaaatattttttaagaatagccttaaagtctggctgttgtttatttgattatgaattatcagaatagcgccggaataaggttattcctctgctcagggacgaatgagtaggctaagagtcttcttaataagaaaaatggcaaccgaatcagggccagtttttaatcaaaggcaggaaaagatgaatcgtataacgtggatcgataatctgcggggattgagtattctcgcaatcatttttttgcacagcactattgccgtacataataacgccggacattttaccgccttcagcggcctgttaaatgagatgctggcaccggtaaggctggggctgatgttctttgtttcaggtttatttgtcgatgccgggttaagaaaaggcctgggtcctttttttaataacaaggtgcgcagtattctctatccatttgtggtctgggttgcagtctacggcgggttgaaaatcctgttcagctcgatggctaatacgccgcaatcaccgatgaatattattctctcccacctgaccggtggcggtgatatgacctggttcctgcattcgctgtttatcttctttattgcgattatctttgcccgtcacttgccgttcctgctggtgtttgccatctgtatgacgctgagctgggcgctgccagcgattgaggcggatggggtgtttgccagcttcgacaatacccacatcaataaatcgctttatctgtttgtattcttctatctcggcgattacgtcgtgaggaagcaggtggatatcgcggagaaagtgcagcatggcccgacgctgtttatctcagtaattagttttgtgctgctctcctgcctgaatatctttgtgctggaacgtcattcccaggcgttattgtcaccgctggcactattatcggttccgttctttgtctggattgcgctgaaactgaagtctgaactggtctactacattggcgtcaattctatcgtcttctacctgtcgcattatctggcgattcagttcttcagtaagattgtgaagtttgaaagcccgtcagcctgggtaaatgacctgaagtttatttcggcattcctggtggcgctggcgttaccgtggacattatgtctgatgagaaaacgcggctggtttaatttcctctttacgatgaaaaagtcatcgaagccgatgacaaccaaaccggtttaattactgcagcagaaataaaaagggccacccgttttaccggcggcccttttttaatcaggttttaatcaggcaatctgcaccggcagcgctttcgccagacgcttcatctggttgtcaccttcaaaataggcgaccttaggctgccactgacgcgcctcggcatcgtctacctgcacataggagcagataattaaaatatcgccttcgcaggcgcagcgggcggccgcaccgttgactgagatgattttcgagccacgctcagccgcgatagcgtaagtggaaaagcgctgaccgttggtgacgttataaatatcgatcgcttcatattgcagaatgccggaagcatccaggaaatcctgatcgatagcgcaggaaaccttcataattgaggtccgcctgcgtcaccttcacgcggtgcaatttgccttgcagaactgtgcgaatcatagccagaaaccttgtcagagaaataaaataacctgcagcgggatgaattactgcgtcaggtcaacggtttgattatcaatcaggcgggccttgcccagccaggcggccatcagcaccaccgcgcgctggctgtccaccgtcagcggttgcagcgtttccgcatcacagatcgccaggccatcaggacgcaatccctgcgccagcagtgcctcactggcaacctcaatgatctcgtcaatatgacgctcgccattctccagccgcgtcgccatctgatgcatcacctggctcaggaccggagccagcttacgctcatctgccgtcaggtagccgttacgcgaactcagcgccaggccatctttagcgcgcaccgtaggcacaccaacaatctcaatgtcgaagcccatatcggccaccatcttacgaatgatagccagctgctgaaaatccttttcaccgaaacaggcaatatcgggctgtaccagattaaacagtttgctgacgatagtggccacaccgcgaaaatggcctggacgtgtggccccttccagcagggaagagagcaccggcacctcaacaaaggtctgattctgcgcgccctgcggatagacttcagcaggtgagggggcgaagaccacgtcaacctggtggcgattcagcttttcacaatcttcctgcagcgtgcgcgggtagcgcgctaaatcatcggcgcgatcgaactgcatcggattgacaaagatcgagacaatcacgatgtcgccgcgcgcccgtgcttcatccaccagcgtcaggtgaccttcatgcaggttgcccatggtcggcaccagcgcaatgcgtttaccctgctggcgccagcgtcggacttcctggcgcagcatcagcagcgtttcaatgatcaacacggtgactctcctggattactggaaactgtgctctgccgccggataggttccggcctcgacttcggcgatatagtggcgaatcgccgcgcgaacatcgccggtctccgccaggaaatttttggcaaatttgggaatgtggccgccggtcacgcccagagcgtcatgcatcaccagaatctgaccatcggtgacattgccggcaccgataccgatcaccgggatggtgagcgcgtcggtaatccgctgcgctaccgacaccggcacacactccagcaccatcagctgtgcacctgcggcttccagcgccagcgcatcggccagcaactgctctgcaccggcttcatcccggccctgtactttatagccgccaaagatattgaccgactgcggtgtcaggcccagatgaccacataccggaacggcccgctcggtcagcatctgcacggtctcagccagccagctgccgccttccagcttcaccatgttagcaccggcacgcatcagctgcgcggcgttgtcaaaggtctgctgtggcgtggcataactcataaacggcaggtcggcgagcagcagtgcctgtggtgcgccacggcgcacggcggcggtgtgataggcgatgtcgctgaccgtgaccggcagggtggaatcatgcccctgcaccgtcatccctaaagaatcaccaaccagcagcacctgaataccttcatcggcaaacaagcgggcaaaactgaaatcgtaggcggtcagggtcgcgaattttttaccgctggctttcgcctgacgcagatgtgaaatcgtggtgggtttcatggcgctctcaactcaggaattctgatgggcgcagtttactggatagcgtgaaagagcggaatcagagatgtgcgtttgtctgctcagccgtgccacagcacgatgctgctactgtcgaggttagccaggattgtgctgagtgcgcgaccgtcgggcaggcgggcgtctggcgcaatcgccagcaggggcaccagcataaacgcacgattcagcagatcatagtgcggcacaatcagccgctccgtgttgatttgcatctcgccaaacagcatcagatcgatatccagcgtgcgcggaccccagcgtttctgccttgcgcacccggccatgctcccgctcgatccgctgggtatggtcaagcagcgcttcggcactgagatcggtctccagcgccacggcggcattgagaaaatcgggctgatcgggcgggccataaggcggcgtgcggtagaatggcgaggtagcgatgcgttgcgtctgcggcaacgcatccagtgcggtcagcgctgcatcaacctgatgcagcggatcggccagattactgcctaacgcgaggtaaacccgtgtcatgagacgttctggttgtcacgacgcggtgcggaaggacggcggcgcggacgacgcgatttattacgcggcaccggatcgtcacccaggttattgagcatgtttttctgatgcggcggcgcagccacctggaattcaccccaccactggctcaggcgcagcagttccgggttattttccacttccgcccgcagcgccagcagatcgtaagcggcgcggaatttcggatgctccatcagtttccaggcgcgtttaccgtgacggcgggacatgcgtaactgcagcagccagatatcgcgaattagcgacgtaatacgtttcggaatcgccagcgcacggcaggcttcgtccagcgtatcgttcatcgccatcgcaaaagcttcgaagtaggtcaggccactctcctgcgcaatgcgttctgccgtttcaagctgcggataccagaacatcgcggcaaacaggaacgccgggttaacgcgcatgtcgttgtgaatgcggttatcggtgtttttcagcacctgcgccagcatccgctccatgtggctatcgctgttttcggtgaagttgcgcgccagcgtcgggaacaggggctggaacagctgatattcacacagcttgagatatgtgctgtagccgtagccagcctgcaacatcttcagcgactcttcaaacaggcgagcaggcggaatatcacgcaacagcgaggccagacgtggaatcggctcggcggtttccggcgcaatgctcatattgagtttggcagcaaagcgtgcgacgcgcagcatgcggaccggatcttcgcggtagcgggtttccggatcgccaatcaggcgaatgatgccctgttcgagatcgctgatgccgccgacatagtcacgcacgctgaaatcagccacgctgtagtagaggctgttgatggtgagatcgcgtcgctgggcatcatcttcgattgagccgaagatgttgtcgcgcagcagcatgccgctctgggcacgctgcgagctgttgcgatcctcttccggctcttccgcctgatgatgtccacggaaggtggcgacttcgatcacttccgggccaaacatcacgtgcgccagacggaaacgacggccaaccaggcgacagttgcggaacaacttacgcatctgctcaggcgtggcattggtggtcacgtcgaaatctttgggtttttgccccagtagcaaatcgcgcacgccaccgcctaccagataggcttcataaccggctttgttcaggcgatagagcactttgagggcattttcgctgatgtctttacgtgagatggtatggctttcacgaggaatgatggtcatcagacgctctggttcaacctctgctggggcttcctcttcatcacgcttcaggactttccggcaaaaattagctactcgggtaaaaatgggacacctcgacagtggcaattagggtgtaggtaaaatcagcggctaatcatagcctgttgagaaccgtttgagaatgctgttgtctatgcatccggtttcagggcgttctcttgcggcatcaaagcgatattccactgcgacaccgcatcagacagcagtttgtcctgcgttaagtcctgccagccgcctgaaaccggctgtccgaggaagcgtaacgccgccaccaacaggggtctggcatcgccatccggcagcgcaggtgcatgattctgcttcgacaacttatgaccatcgtggttaagcgccagcggcagatgcagccagtcaggcactggccagccaaattgctggcagagcgcaatctgtcgcaccgtcggctcaatcaaatctgcgccgcgaaccacttcggtaatgccctgaaaatgatcatcgacaacgaccgccaggttataggcaaacaggccatcacggcggtgaataataaaatcttcctgtgccagacgcctgtccgcctccacacggccacgcagacgatcgtcaaacgcaaagaccggcgcatgctggcgtaaacgcagcgcggcattctccggtccgcgttgccgttcacggcagtaaccatcatagaaaccgccaatctgctgaatgcgacgccgggggcaggtgcagtaatagctttgacgatgctgctgcagccaggccagcgcgtcacggtaggcctcatgacgttgtgactgccacagaaacctcgccatcccactctaaaccgtagtgctccagctgatgcaggatacggctggcggcacccggtacttcccgtggcggatcgatatcttcaattctcacccgccagacgccgttttgcgcacgcgcgctcaggtaactgcccagggcagcaatcagcgatccgaagtggagttcaccagagggagaaggggcgaagcgaccgatacaggaggatgacataggtttcagaagtgaccacgcagcggacaaaacagcagttgttccactgcgtggtaacaggctggacgcggcatcagccggccatttgtttctcacgaatttctgctaacgtcttacagtcgatgcagagatcggcagtaggacgggcttcgagacggcggataccaatctcaacgccacaggaatcgcaatagccgaagtcgtcatcttcaactttcttcagcgtcttctcgatctttttgatcagtttacgttcgcgatcgcggttacgcagctccaggctgaactcctcttcctgcgcggcacggtcaaccgggtccgggaagttagcggcttcatcctgcatatgagaaacggtacgatcgacttcgtcccgtaattgattacgccaggcttccagaatcttgcgaaaatgggtcagctgcgcatcattcatatactcttcgccaggcttcacctgataaggttcgacgccagcaatagagagaatactcagggacgatgttttacggttttgaccttcttgcatgttgcttctcctggataacacgcactatacccttcgaatttcgtctcgcaggggccttgctgccagcctgcatttgacgtctgcggggtacatcgatcccccattggggaaaaaaacaggccgctataaataacagaagcagtcagggttggcaattcttcatgaacacaccttgacaagcctgtgaggaacagcgtaattggcccttagctcagaacattcttaacacataaaattgcaaaagatattacaaggttacgttgatcggcgatttaagaaacattccctccgccgataagtctgcctgatacgctaaaacctctacgccctcctgctgcgcctgagccagttgttctgcatacgccacatcaatgtgccgtgccggggaaacgtcctcaatccccgagtgcaaaacggcaaacaacaaaacggcccgatgaccctctgccgcaactgttgccagttcacgcaggtgtttctgtcctcgaatcgtcaccgcatccggaaaatacccttttccatcatgtagaagggttacggatttcacctcaatatagcagttgcgccgggcctctgctttgagcaggaaatcaattctgcttttttcagtgccatatctcacttccgcctgacgatgcgtataaccggccagcgccggcagccgttcctgctccagcgcctcagccaccagttggttggcgcgcagcgtattcacgcagatccagtggccctgttgtgtttcggtcagctcccagctgtgggggtatttgcgcgtcaggctgtcggacgtcgagtaccagacgcgatcgcccggcgtggcgcagccggtcatggcgccggtattggcgcagtgaatcgtcagaaacgtcgccctctggcgtcaccacatcggccaaaaaacgtttgtaacgggcaatcagacgggcgggtttaaggggcggagagaagtgcatgtggatcctgagaatgtaatggccagctagccagggcgcgatagcgggtgcggccccgggcatattcagaggcgaacagagaaaaggtggagacgcgaaaacgccagtgaaagccgcgcggcggtaacgtcaccggctgcgtggcgtggcgtaacagcgtgatgtgcggatgaaacggctgggggctctggtaacagccatgccgggcggcctgggcccgcagcaggctggcgagctgcaacagaccgcgtggcgcgcgctggcagccgagccagaccacgccggggcgcggccagtgtccggcatcatccaggtcgagatcaaaaccgggctgcacaatacgggaggccagcgtctgcaggcgctgtgaggtttccggcgcaacttcacccagaaacgccagcgtcaggtgcagattcgccgcgaccaccggctggcccgcctccgcaggaaaggtatcggcccgccagcgcaccagctcttgctgcatctcgtcaggcaggctgatggcaaaaaataagcgttgtgtcgccatggcgctctccggcaaatatcacggatggatgctacaatgcgcgccatcttagcacaggcagaagcggagtttgctgtgagcgatttaccggtcagcgcggtgctgcctgacatcctggcggcgctgagtgacgccccacaaatcctgctggccgcgcccacgggggcaggcaaatcaacctggctgccgctgcagttgttacagcaggcggcgctgccgggacggatcatcatgctggagccacgtcggctggcggcgcgtaatgtggcgcagcggctggcggagcaactcggcgagcagccgggtggcacggtgggattccggatgcgtggcgaaagctgcgtcgggccgcagacccggctggaagtggtgaccgaaggcatgctcacgcgcatgcttcagcacgacccgatgctggaaggcgtgtcgctggtgatcctcgatgaatttcacgagcgcagcctgcaggccgatctggcgctggcgctgctgcttgatgtgcagcaggggctgcgcgacgaccttaaaatcatgctgatgtccgccacgctggacaatgcccggctggcggcgctgctgccggatgcgccactgatcgtctcagaagggcgcagctatccggttgagcgacgttacgcgtcactgaatcagaatgtgcgttttgaagaggcggtcgcgcgtgaagtcgcccagctgctgcgggatgagagcggttcgctgctgctgtttctgccgggtgtggcggagatcgaacgggtgaagcgcgagctggaatcacgcatcagtgacgacgttgatctgacgccgctctatggcgcactgccgctggcggcgcagcgccgggcaattctgcctgctgccgacggccgccgcaaagtggtgcttgccaccaatatcgccgaaaccagcctgaccattgaggggattcggctggtggtcgacagtgcgctggaacgcagcgctctgtttgacgcccgcagcggcgtgacgcgtctgcagacccagcgaatcagccaggcatcgatgatccagcgagcgggtcgcgccgggcgactgatgccggggctctgcctgcatctggtgccgcaggagcaggcatcacgagcggcggcgcagagtgaaccggaaatcgttaacagcgatctctcgtcactgtggctggatctgctgcagtggggctgtacccagccgcaacagctgcagtggctggatcagccgcccgccagaaatctggatgcggcgcagcagcagctgacccgactgggagcactggacaacaacggcctgctcaacacgctgggacggcgcatggcgcagctgggatgcgatccccgactcgccgccatactgtgtgccgcaggcgatgagccggatgcggtcgccagcgccacgctgctggtggcgattctggaagatcctccccgcagcggcagcgccgacctgcgtgatgcgctgcatcggccgcaggcgcaatggcagcggcgggcgcagcagtggcagcagcggcttaaaatccgtggcgggcgcatcgatgaagatcgtttcgccggattgctggcggtgggctttggcgatcggctggcgcggcgacgcgatcagagtggtcgctatcagctggccaacgggctgggcgccagactcgatgagcaggatggcctgacgcgtaatgaatggctgattgcgcctgctctgttgcagggcagtgccacaccggatgcccggatgttgctggcactgccggtcgatattgaaacgctgtgccagcagcagcccgccctgattgagcgccggaccgaagtagagtgggacgaagagaaaggcacgctgcgtgctttcagacgtgagcagattggcgcgctgatactgaaaacccagccgatggcgcgcccggaaccggaggtgctgcacgcggccatgctgcgctggatcgtcgaaaaaggtctgtcggtactgggctggacaccggaggccgaacagctgcgtctgcgaatccagtgtgcggcccggtggctgccggaagagagctggcccgcgaccgacgatgaaacgctgcttgagagcctgtcgcagtggctgttgccgcagatgtcagcggtacgcgatctccgcagcctgcaggcggtgaacctgaccacggcactcttacatttactcacatggtcacagcgtcagcggctggatactgtgctgccaactcattacactgtgcccaccggaagccggctgccaatccgctacgatgcggagaagccgcccgcgctggcggtaaggattcaggagatgtttggcgaagcgcagaatcccaccgtggcggaaggacgcattccgctggtgctggagctgttatcgcccgcccagcgcccgttgcagatcacccgcgatctggcggcgttctggcgcggtgcctggccggaggtcaggaaagagatgaagggacgttatcctaaacatccctggcccgaggatccggccaccgccttgccaacaaggcgaaccaaaaaaatgtccccgcagggttgagtccgctggatcgaattcagagggttctgccatgcggcacgcgagaaagcagttagagtagcggcgctgccgtaagcactgcctggagaagaaaagtaatgtctgggaacgatcgcgaaccaatagggcgcaaaggtaaaccgttgccgccgcgcagcagtgcgggccggggacgacgcagggatatcgaacaggatatcgatcaggacgattttaatgatgacgaggaggaagcgccggtgccacgtaaaggtaaaggtggaaaaccgccgcgcggcaaacgccgttggctgggatgggtaatcaaactgttcctggtgtttgtggtggtcatggccgcgtggggcatctacctcgactcggaaattcgcagccggattgacggtaaagtgtggcaactgcccgccaccgtctatggccgcatggtcagcctggaacccggcatggcctacaacaaaagtgaaatggtggcgctgctggaaggtactcagtatcgcgaagtctcccgtattacccgccctggcgagttttcggtgaagggcaacaccatcgatctgctgcgtcgcccgtttgatttccccgacagtaaagaggggcagatccacgcgcgcatgagcttcagtaaagatgagctgagcgagattaaaaacctcgaaaccggtcgtgattttggctttttccgcctcgatcctcgcctgatcaccatgctgcagtcgccgaacggtgaacagcgactcttcgtaccgcgcgccggtttcccggatctgctggtcgatacgctgatcgccaccgaagatcgccatttctatgagcatgatggcatcagcccttactccattggccgcgccttcctggcgaacatcacggccgggaaagcggtgcagggcggcagtacgctgacgcagcagctggtgaagaacctgttcctcaccaacgagcgttcgctgtggcgtaaagcgcgtgaagcctacatggcggtgatcatggatgcgcgctacagcaaagatcgcatcctggagctctacctgaacgaggtctatctcggtcaggctggcagcgatcagatccgcggtttcccgctggccagcctctactactttggccgtccggttgatgagctgagtctggatcagcaggcgatgctggtcggcatggtgaaaggcgcgtcgctctataatccgtggcgtaacccgaaactggcgctggaacgacgcaacctcgtgctgcgcctgttgcagcagcagaaagtgatcgaccaggagctgtatgacatgctgtcggcccgtccgctgggcgtgcagccgaaaggcggcgtgattacgccgcagccggcctttatgcagatggtgcgtaacgagcttcaggcaaaactgggcgacaaggtgaaagatctctccggggtgaaaatcttcaccacgctggatccggtgtcgcaggatgcggccgaaaaggcggtgatcgatggcattccgacgctgaaaaaacagcgtggtctgaaagatctggaaaccgcgatggtggtggttgaccgtttcagcggcgaagtccgcgctatggtcggcggtgccgatccacagtatgccggttacaaccgcgcgctgcaggcacgtcgctctatcggctcactggcgaaaccggcgacttacctgaccgcgctgagtcagccaaacagctaccggctgaacagctggatcgccgatgaaccgattgcgctgaaacagccaaacggcagcatctggaaaccgatgaacgacgatcgtcgcttcagcggcaaagtgatgctggtagatgcgctgaccaactcaatgaacgtgccgaccgtaaacctcggcatgacgctggggctggatgcggtagtggatacctggaataagctgggcgtgccgaaagagcagctgcatccggtgccatcgatgctgctgggtgccttaaacctgacgccggttgaagtggctcaggcgttccagtcgattgccagcggcggcaaccgcgcgtcgctgtcagcggtgcgtttcggtgattgcggaagatggcagcgtgctctatcagagctatccgcaggcgcagcgtgttgagccggcgcaggccgcttatctgacgctctacaccatgcaacaggtggctgaccacggtaccgcccgtgcactgggcgcgcgtttcccgaatgcgcatctggcgggcaaaaccggtaccaccaacgatctggtggacagctggtttgccggtattgatggtaaagaagtggcgatcacctgggtgggacgcgataacaaccagccgaccaaactctatggtgccagcggcgcgatgcagctctaccgtcgctacctggacattcaggccccgatgccgttacagctgacgccgccggaagatgtgtcgctgatgaatgtggattctgccggtaactttgtctgcggcacgggcagcagcacctggcgttctctgccagtgtgggcgctggatccgaatgcgctgtgtcagcaacagcagcagcaggttcagcagcaacaacagctcttcgatcagcagcagcaacaacagcaacagcagcagccgcaacaaccggcccagcaacagcaggagcagaaagatagcgacggcgtagcagggtggataaaagatatgtttggcaaataaatcagtcagacaggttaaaaagggcgcttcggcgccctttttttgttcctgatcaatacgcgtcaatcggcctgcaaacggcgtcactactgggatttcttcttgcagtgcctgctgaatttcgcatattatctaagcgttataataatcattatcgtttcgattcgcctgcctgagcctattgttaagagacacttttatgaatgcgcgaacgactttttctgacaacaccaaaaaaacattttcccgaccgcttctgggcatcatgatctcactgagcctgagctcctctctttacgccgcgcagacggagacgatggtcgtctcggctgatggcggcagcggcgtcgaggcggaaagcgcctggggaccagcacccaccgtggcagcgaaacgcagcgccaccgggaccaaaactgatacccccattgaaaaaaatccgcagtccatctccgtggtcacccgtgaagagatggagatgcgtaacgtaaccagcgtgaaaggggcgtttaactacacgcctggcgtgctgaccggtaaccggggcagctcagacgtgattgatgcgctgtcgattcgcggtttcagcgaaaccaacaccaatcagtatctggatggtctgaaactgcagggtgataactactctgagtttgccatcgatccttacttcctggaacgcgctgaactgctgcgcggcccggtttcggtgctctacggtaagagcaatcccggcggcgtggtctcgctggtgagtaagcgtccgacccaggaaaccctgcgcgaagtgcagttccagatgggcaacgataacctcttctcgaccggctttgactttggcggcgcgctggacgacgacggcgtctacagctatcgcctgaccggccaggcgcgcagtcaggatgcgcagcaggcgatgaacaaagagaagcgctacaccatcgcaccggctttcagctggcgtcccgacgatcgcacccgcattgacctgctgacctatttccagaacgagccagaaaccggttattacggctggctgccgcgtcagggcacggtggtaccgatcacccgcgccgatggcagccagtacaaactgccgaccaactttgatgaaggcgagcagagcaacaagatttcacgcaacaccaaaatggtcggttataacgccgagcacagctttaacgacacctggacgctgcgccagaaacctgcgttatgccgacctgcgcaccgattaccgcagcatttacggcaatggtttcctgccggcgactcaggaaatcacgcgcggttcggcggtttcagaagagaagctcaaccaactggcggtcgatacccaggcgcaggcgaaattcgccaccggccaggttgatcatacgctgctgctgggcgtggacttccagcgtacccgcaatgatatcgacgcacagtttggcactgcctccagcctgaatgcggttaatccgcaatatggtgataacagcgtaacgccatttggtccttatcagcatctcaacaagcagcgtcagaccggcctctatgctcaggatcagatggagtggaaccgctgggtgctgacgctgggtggccgctacgactatgccatgaactcggtttacgatcgggtagcggatagcgttgatcgtcagaacgatcaggcctttacctggcgcggcggcctgaactatgtgtttgataacggcatcgcgccttacttcagctacagcgaagcttttattccgaatgcgggttcgacctatgacggtcaggcatttgatccgtcacgcgctaagcagtatgaagcgggcgtgaaatatgtaccgaaagatcgtccggtggtgctcaccgcagcgctttatcagctgaccaaaaccaaaaacctgaccgcggaccctgatacgtttaatcatccgtttgccagcgtgcagagcggtgaaatccggtcacggggcgtagagctggaagctaaagcggcgctgaatgccaacgttaacctgacggcgtcctacacctacaccgatgcggaatataccgaagacacccagctcaaaggcaaaacaccggtgcaggtgccgaaacatatggcctcactgtggagcgactacaccttccacgaaaccgctttgtcaggcgtgacgatcggcgcgggtgtgcgttatgtcggtgagagtcagggcctttacagcactggcactgagcagaaccagaactttaaagttgccggttacaccacggtggatgcggcgctgaaatatgatctgggtcgtttcggtttgccgggttcgactgtgggcgtcaacgtcaacaatctgtttgaccgcgactacgtcgccagctgctatcgtgaatacgcctgctactggggtgcggagcgccagattgtcggcaccgcaaccttcagattctgatttaaccgggcacttcggcgcccgtttcacagggataaccatgccgtatccgcacgcagaagaggcgacctttacgctgaaaaacgccagttttgaagtgccgggccggacgctccttcagccactgtcgctgacctttccgccgggaaaagtgaccgggctgatcggtcacaacggctcgggcaaatcaacactgttaaaaatgctgggtcgtcaccacgcggccagcagcggagaggtgctgttgaatcagcagcccgtcggacgctggaacagcaaagcctttgcccgtcaggtggcctatctgccgcagcaattaccggcagccgaagggatgacggtgcgtgaactggtggcgattggccgctatccctggcacggcgcgctggggcgctttggtcaggaagatcgcgaccgggtagaggatgcgattgcccaggtcgggcttaatgcctttgccggacggctggtagatagcctgtcgggcggcgagcgtcagcgcgcctggctggcgatgatggtggcgcagaacagccgctgtctgctgctggatgaaccgacgtcggcactggatattgcccatcaggttgaggtgctggcgttgataaaagcgctgagccagcagcgcggcttaaccgtgattgcggtgctgcacgatattaatatggcagcacgctactgcgatcatctggtggcgctgcgtcagggcgcgatgattgccgaaggtgacgcagaggcgattatgcaggctgaggtgctcggtgcgatttatggcattccgatgggcattttaccgcacccgcagggcggcgcgccggtcagttttgtctgttaaggagaggatgatgcccgatcttaatcgccgccgactgatgctggcgctggcagtctctccgctgttttgtgcgcttcccctgcgtgccgccacgccaaatccgggtcggattattgcactggagtggttacccaccgaactgctgatagcactaggcgtcacgccctggggcgtggccgatctgcacaactacaatatctgggtaggggagccgccgcttcctcagggtgtgatcgatgtaggtctgcgcaccgaacccaatcttgagctgatggcgcaaatgcagccgtcgctgatcctctgctccaacggctacggcccgcctaaagagaaactgacgcgcatcgcgcccatcatgggcttcgacctccacagcggcgacgggaaacctctcactgccgcgcgcgcatcgctgcgtcagctggcggcgcgccttggattaagcgcgcgagcggaacagcatttgcgcgaggtcgatgatcagctggcggcggcgcgccagcggctggcgccctatgccggacgcactatcctgctgatgtcgctgctcgacagccgtcacgccattaccttcggcaaaaatagtctgtttctggaagtgatgactctgctgggcctgaaaaatggctggcagggcgaaacaaatttctggggcagcgcggtgatcggcattgaaaagctggcgcaggtcggggatgtggatgtcatctgctttgatcatgataacgatgcggagatgcagcaactgatgcgcagcccgctatggcagtcgctgccgtttgtacgcaccggacgctttcagcgcgtcccggccgtctggtattacggtgcgacgctctcggcgctgcactttgttcgcgtgctggaacgcgcgctggagacgcactgatgcgccatgctctgtttcccgtaggcctcctcagtctgctgtttctgctggcgctcagcctgacgctggtcaatctgcatcaggcgttaccacaggctgaatggtggcaggcactctggtcaccggcggtcgatagcctgccgcagatggtgtttcaccacagcctgctgccgcgtatcgtgctggcgctgctggtggggagtggactggggttagccggtctgctgtttcagcagatattgcgtaatccgctggcggagccaaccacgctgggcgtctcttccggcgcacagctgggcattaccgtggcgacgctgtggcatctgccgggcggggcgctgacacagcagtttgccgcgctcagtggcgcgctgctggtgggcgcgctggtgtttggtgtggcctggggcaaacgtctgtcgccggtaacgctgattctggccgggctggtgctgagcctctacagcggcgcggtgaatcaaatcttcgctatcttcaatcacgatcagctgcagaacatgtttctgtggagcaccggcgcgctgaatcagatgagctgggaaaatgtgcagcaactctggccgcgcctgctgctggcgtttgtgctggcgctggcgctgctgcgtccgctgacgctgatggggctggatgatggcgtagcgaaaaaccttggccttgcgctttccgtggcgcgtgtcggtggcctcgggctggcgatcctgctcagcgcacagctggtcaacgtcgccggtatcatcggctttatcgggctgtttgcgccgctgctggcgaagatgctgggtggacgacggctcatcacccggatgctgctggctccgctgactggcgcgctgctgctgtggctggcggacagttgcgtgttgtggctcagcacccactggcgcgatatcccgaccggcaccgccacggcgctgctcggcgtcccgattctgctgtggctgctgccgcgactgcgcaccggttcggtgccgcccgcgctgaatcagggtgataaggtgcccgtcgagcgacagaaaacctgctgcgctgggcgctgaccgggcttgccatcctggcactgctggggtggggcggtctggcgtttgggcgagatgcgcagggctgggtctggtcagcgggtgagatgctgcaatcgctgctgccgtggcgcgcaccgcgcgtgctggccgcgctggtgaccggcctgatgctgggcgtggcggggagtctgattcagcggctaaccggcaatcccatggccagcccggaagtgctgggcatcagttcgggtgccgcttttggcgtggtgatgatgatgttctttgtaccgggcgatgcgctggcctggctgctgcccgccggtgcgctgggcgcggcgctgacgctgctggtgatcatggcggtagccagtcggggcggcttctcgccggaacgaatgctgctggcgggcatggcgcttaacagcgcctttgtcaccctgctgatgctactgctggcgagtggcgatccgcgtatgggcgggctgctgagctggatctccggctcgacctataacatcagcggcactcatgcggttcagagcgcaatctgcgcgctggtgctggtgtcgctggcaccgctggccagtcgctggctgacgttgctgccgctgggaagcgctaccgcacgctcggccggtatggcgttgacgcctgcgcggctgagtctgctgctgctggcggccgcgctgaccgccagcgcgacactgactatcggtccgctgagttttgtcggactaatggcgccccatatggcgcgcatgctgggattccggcgggcgttaccgcaactgctgctgtcaggattactgggggcgggattgatggtgctggctgactggtgcggacggatgctggcattcccggatcagatcccagccgggctgatggcgacctttttaggcgcgccttactttatctggctgctgcggcgttcaggttaagaggaaaaagcaggctggtttcagacgccggccagatccaaagtagggtgaatctgacaacaacgaagaagctcaatgcgcaggaaattgggtcagaggaggaaagcgtcccgcgccagggacggcgcgggccgagcgagtcatggatgacggctttcgcgcctttccgatctgaccctgtttcctgtgcgtgcaccctctcacaacagagcggggcaagcctcatcaataacaaaagaccggctgctgccggtcttcatctttaacgctgccgcaattacagcttcgcgaaacaacgacgcgcggcgtcgacagtgcgctgaatatcctcttcgctgtgcgccagcgacataaagcccgcttcataggctgaaggcgcaaagtaaacgccctcctcaagcatcaggtggaagaaggttttaaagcgctccacatcgcagcgggttacatcggcgtaacaggtcacactgtcagcatcggtgaagaacaggccgaacatcccgccaacatggttaatcaccagcgggatattttgctgttgtgctgcttcacgcagaccctctgccagcttgcgggtcagggcatccagcttctcatgggtacccggctgcgcgatctgcgtcaggcaggcgaaacccgccgccatggcgattgggttaccagagagcgttcccgcctgataaaccggaccggtcggggccagcgctgccatcacttcgcgacgcccaccgaatgcaccgactggcatgccgccaccaatgattttcccgagacaggtcaaatcagggcgcacattgtaatgagcctgcgcgccacccagcgcgacacggaaaccggtcatcacttcatcaataatcagcagtgcgccgaactcatcacacagtgaacgcagacccggcaggaactccggctgcggtgggatgcagttcatgttgccagccaccggctcaacgatgatggccgcaatcgactcgggatattgctcaaaagcgctgcgcactgagtcgagatcgttaaaggtgcaggtcagggtatgtttagcgaaatcggccggtacgcccggcgagtttcggctgacccagtgttaacgcaccggagccggctttcaccagcagatgatcggcgtggccgtggtagcagccttcaaacttgatgattttatcgcggccggtaaagccacgcgccagacggatagcgctcatagtcgcttcggtgccggagttgaccatccgcaccatctccatgctcggcaccagctcacacaccagctgtgccatggtcacttccatttcggtcggtgcgccaaaacttaagccgcgctgtgccgcttcaatcacggcgttacggatcgccgcgttgttatgacccagcaccatcggaccccatgagccgacatagtcgatataggctttgccgtcagcgtcatagagataggcgccatcagcgtgttcaataaacagcggaacgccgcccacaccggtaaatgcgcgtactggcgagtttacgccacccgggatcaggcgttgtgcctcggcaaacagttgttcggacttactcattttcggctccagcggttcataaaaatattgcgccattctacggaagaggagcagcagacgaaaggtggattcaccccctgtgcccttaacaggagtgaaagcggcacagagtgcgaagggcagagcttgattgcgctgaggtgctggctgataatagcgtaattaaggtcgttttctgacctgggcgtttaccggagtaaaacatgagtgatgaagtagtagcactgccgttgcagtttaccgacgccgcagccaccaaggtgaagaacctgattgccgacgaagagaacccggcgctgaaacttcgcgtctatatcaccggtggcggttgcagtggtttccagtacggcttcacctttgatgaccagatgaatgatggcgacatgacgattgaaaagcagggcgtctcactggtggttgatccgatgagcctgcaatatctggtgggcggttcagtggattacacggaaggtctggaaggctcacgctttatcgtgaccaacccgaatgccaaaaccacctgtggctgtggctcttccttcagtatctgataatgcaggccgtcatacagacggcctcgtttaccattctattgtgaccagccggttactttgcttcacacttccctgcgattgaatctggccgtttgttacgcgcggctgcgcgcttgcctgtctgccgcagttgatctgcggcgcgggctgaccgttagccgtgttgatttcacagcgtgaatagatgacaagtctggcgccaatagagccatttatcgatcctgcaaaggcagaaccggcgatcgacagccctatggccagcagcagtgctctggtcatataaggttcctggtgttttaaaaaagcgccggagcgctaaaaggacggcgagcatacgtggcgcgttcgtctctggtattgatcaacggcaaaaatcgcagtgactttaatcaattcgccgatttattcatcgggatgcagggccgcacagagttgctgcgcggccagcagcagtcgcgggcctggccggctaagccagtcctcgttgatggcaatcaccggtacatccagctgcggtcgccagaacacccggatgttttccgcctgctgcgcactgccacccgtcacaacggcctgaggatggcgcatcagcacctgctcacggctgacctgcggccagctgacgcggctgtcagcaaagatgttcctgccgccacataacgtaataatttcattctgcagcgtggctctggcggcggtaaacaggggctgctgaccaaactgcaaaaaaagcggaaccgcagtcagatgagcatagcgctgacgcagcgcggcttcctgctgacgtaactggcgggcagcgcgagttgcctgctccggtctgggactccagtggcccagaccggccagcgctgtgaacatctcatccagcgtcagcggatcaatccatttaaccggcacgccgagctgctgtaactggtcaatctgccgctgcggattaccgcctcgccaggctaacaccagatccggcttaagttgcagaatacgttcagccttgatgccctgccagtttgcgacctgctcaatctgtttcgcctgcggcggatagtcggaccaggcgctgaccgcaatcggggtaatcccggcagcaaaggcgagtttcggtaaggtgaggggagagggtaatcacgcgtggcggtgaagccagcaggctgccgctcagcagcagccagcagaggagtagcgttttagccacgcgccagatgcgccagcaggttctccaccatcagcgaagattgcttcgccgcaacgcttaagaactcatcaaagctgaggtgagattgcttatcggccacgtcggaaatggcgcggactactacaaaaggcacctggaattgatgacagacatggccgatagcggtggcttccatctcaacggcaatcgcctgtgggaacagattacgaatgcgcgccagcggttcggcaccattgataaaggcatcaccgctgaccaccagaccgcgtacggcattcagatccagctgctgaatacaggcttctgcagcggcgataagcttgctgtctgccacaaacgcggccggacaacccgccatctgacccggctcataaccaaaagcggtgacgtcagcatcgtgataacgcacttcttctgacaccacgatatcaccgacgctgagcgacggcgctaaaccgccagccgaaccggtgttgatcaccacatccggcttgcagagctgcagcagcagcgtggtacccagcgcggcagaggttttaccaatgcccgatttcagcagagccacctcaacgccctgcagggtgccggtataaatttcacaacccgccagcgacagcgtttgacggttttcaattttgtcgcgcagcagtgtgacttcctgctccatcgcgccaataatgcctgctttcatagtgagttccgctaatgtaaagaatcaaaatttagggcatagtctaccatggcattcaggggattaattcacgaaaaaataaggggtaatccatgtcagcgatcaatttcaggaagaagatcagcttctcgcgcccttataacagccgcaaggaaccggaaggcgaatattacattacgcgccattttgagagcgatcgcggacggattataaactccgccgctatccggcgtttgcagcaaaaaacgcaggtgtttccgctggagcgtaacgctgccgttcgttcccgcctgacgcattcgctggaggtgcagcagaccgggcgttacatcaccaaagagatcctgcaaaccctgaagatgcagggcgggctggcgcagtatggtcttgatgagctggaaggcgcgtttgaaagtctgattgagatggcctgtctgatgcatgatgtcggtaatccaccttttggccattttggcgaggcggcgattaacgactggtttgaagagaacctctctgccgagctggtggatccgctggtggccggcgtggaaggagaagcacagcgtaaagcctttgatcaactcaacgccatgatccgccaggatctctgtcactttgaaggcaatgcgcaggcgatccggatggtgcatacgctgctgcaactgaatctcagttattctcaggtcgcctgcatcctgaaatataccgcgcctgcctggtggcagggggaaaagcccgccgaatttagcgtactcatgaagaagcctgggttttatctctctgagcaggattatattgccgacctgcgtgctgccaccaatatggaagaacaccaccgttttccgctgacttatataatggaagctgcggatgatatctcctattgtattgccgatttggacgacgctgtagaaaaagatatctttaatgttgaaagtttgtatgagtttctcaataaagcctgggggccggttaaaaataatgacgctttcagccggactattggcgaagcctggcgtgaagcctgcagtaaaaaacgccgaagccgcagcgatcaattttttatgtcactccgcgtaaatgttcagagcgtgctggtaagctatgcggtgaaacgttttgttgataatcttcctgctatattcgatggaagttttaaccatgcgctactggaagatgagggtgaagagggccgcttactgcaattgtttaaaaccgttgcgcgccagcaggtctttaatcattctgaagtagagcagctggagttgcagggttaccgggtgattaaagggctgctggagatctatcagccgctgatgcgccttaattacgaagcctttaccacgctgataaatgaagatttcctgcgtcagcatccgatcgaaacccggctttttcataagctctcgggtaaacaccgtaaagcctatttgcataagatgcgtaatctggttgtcgaacataaatatcagcgtctgttgtgggaacgttattatcgcttccggctcattcaggattatatcagtggtatgaccgatctctatgcctgggatgagtaccgacgactgatggcggtagaataagccgccaattgtaaagagcgcgaataaatttttacttttgccttaaacttttaaaggaacttcgcgctaaaacatttatctcacttttcgaccacagcaatggtctgaacagtaatcttattgagaaacgaaaaatgaaaaaaaagaccttaatgttaagtgcgctggcgttgagcctgagcatggcgctcgcccctgttactgtttctgctgcgcaaacggcctcttccgatagcctgcaacagccaagtctggcaccgatgctggagaaggtgatgccgtctgtggtcagtatcagcgtcgaggggaccaccacggtgaaaaccccgcgtatgccgcagcaatttcagcaattctttggcgacaattcgccattctgccaggatggttccccgttccagggttcaccgatgtgccagaacggcgacggtgcaggcggtaacggcggcgcgccagtgcctgatacacagcaggaaaaattccgtgctctgggatcgggtgtcatcattaacgctgacaaaggctatgtggtaactaataaccacgtcgtgaataatgccaccaaaattcaggtacagctcagcgacggtcgtcgctatgacgccaaagtcatcggtaaagatcccagctctgacattgccctgattcagctgcaggaagccaaaaatcttaccgcagtcaaaatcgctgactctgacaacctgcgcgtcggcgattataccgtggcgatcggcaacccttatggtctgggtgaaacggtcacctcaggtatcgtctccgcgctgggacgcagtggcctgaacgtggaaaactacgaaaactttatccagacagatgcggccattaaccggggcaactccggtggtgcgctggttaacctcaacggtgaactgattgggattaacaccgccattctggcgcccgatggcggcaacatcggtatcggctttgctatccccagcaacatggtgaaaaacctgacggcacagatggtcgagtttggtcaggtgaaacgcggcgagctgggcgtgcaggggactgagctgaactccgagctggcaaaagcgatgaaggtcgacgcacaacgtggtgcctttgtcagccaggtgctgccagactcggctgccgccaaagccggtattaaggcgggcgacgtcattgtctcgatgaacggtaaaccgctgagcagctttgcttcgctgcgtgcggaagtgggctcactgccggttggcaccaccctgaaactggggctgctgcgtgacggcaaaccggtcgatgtctctgttaagttgcagcagagcagccagtcaaaagtgcagtccgcgaccatctacactggcattgaaggcgccgatctcagcaatatcgaagcgggtaccaaaggtgtccgggttgataacgtgaaaccgggcagtgctgcggcgcgtatcggcctgaaaaagggcgatgtgatccagggcgttaaccagcaggtggtaaccaacctgggtgagctgcgcaaagttctcgacagcaagccgtccgtttctggcgctgaatgtgaaacgcggcgacagcagtatctatctgctgatgcagtaagcgaacagcaacggatgaagaggcggactgcggtccgccttttttatgtccactttctgcctcgtcagagtgtgatgctcaccgcaaattcggcaaatgacggcctggctctgtgcaattgcacaatgttctgcgtgctgtgcatgcgtattctgtttctcccccctcttttcaggagtaatggatggctacctatcaccttgatgcccggctggcacaggatatcgtggcgcgcaccatgaaaattattgacagcaatgtcaacgtgatggatgcgcggggccggattatcggcagcggtgaccgggaacgtattggggagttgcacgaaggtgcactgctggtgctctctcaggggcgcgttgtcgacatcgatgaggccgtggctaaacatcttcatggcgtgcggcctggcattaacctgccgctgcgcattgatggtgacatcgtcggggtgatcggcctgaccggcgagccgctggcgctgcggcattatggcgagctggtctgcatgaccgcggagatgatgctggagcaagcccggctgctgcatatgctggcgcaggacagccgtctgcgtgaagagctggtgctgaacctgatccgcagcgataccctgtcgccacagctgaccgaatgggcgcagcggctcgggatcgatctcaatcagccgcgtgtggtcgccgtggtggaagtggatagtggtcagctcggcgtcgacagcgcgatgtcagagttacagcagttgcaaacgctgctgaccacgccggagcgggacaatctgatcgcgattgtgtcactgaccgaaatggtggtgctgaaaccggccctgaatgggcatgggcgtcacgatcaggaagatcatcgccgccgcgtagagcagttactacagcggatgaaagagagcggtcatcttcggatgcgtatcgcgctgggcaacttctttaccggacccggcagcatcgcacgctcttaccggacggcgcgcaccacgatgatggtgggcaagcaacgtatgcccgaggtgcgcagctatttttatcaggatctggtgctgcccgtgctgctcgacagcctgcggggtggctggcaggccaatgagctcgcccggccactggcgaagctcaagagcatggataacaacggcttgctgcgccgtacgctgatcgcctggtttacccataacgtccagccgagcgccaccgcgcgtgcgctgttcattcatcgtaatacgctggaataccggctgaaccggatttctgaactgaccggactgaatcttggccattttgatgacaggctgttgctctatgttgctttgcaactggatgagcagggctgaagtgaagatttgcggcataaaaaaggccagcaatgctggcctctctggtcgggcaggaaattaacgaccgttacgggttaatttttccagatccgattcaatttcagtgatcttatgtgaaaccacgctttccaggtgacgcaggtcatccagaattttgcgtttcagatccacttcaacctgatcgcgctggcaaatctggtccagttcatcgatgacataacgcagattcgggctgatttcctgaacttctttgtagccctgggtcgcgtgatcggcaacaaccgttttgcgctggcgcggatatttgaatttaacgctcttcgcgaaaaactcacctttatctttgcggaagtagattttcagaatgtcgttattggcttcctgacgcaggctatagcggtcaatgtcgtctgggttactgatacctaagcttttcagattgtcatacatagcgttgtttccatcaaaagtgagaagcgcgcagacttgttcatgacgtccgtcaactgtagacataaataagcgggatgaacattgcgcgacaggatttaactggcgcggattatgacctggataaaaactaaacgcaccagttaattcgcgacgcgaagcatgttgttcaggaatcactgtaaagaaaagatgacgggctggaaaccagcccgtcgcttaaatcagtcgatggtgcgcagcagctcgttaatacctgttttgccaagcgttttcgcatccactttcttcacgattacggcacagtagaggctgtagctgccatctttagagggcaggttacctgagaccaccacggatcccgcaggaacacggccgtaatgcacttcgccggtctcgcggtcatagattttggtgctctgaccgatgtaaacgcccattgagatcacggaaccttcttcaacaatcacgccttcaacgatttcagagcgcgcgccaatgaagcagttatcttcgatgatggtcgggtttcgcctgcagcggctccagcacgccaccgatacccacgccgccagaaaggtgaacgtttttaccaatctgtgcacaggagccaacggtcgcccaggtgtccaccatggtgccttcatccacaaaggcgccaatgttgacgtaagaaggcatcagcaccgtgttgcgggcgatataggcaccctgacgcacagccgcaggcggcacgacgcggaaaccggcttctttgaaacgcgcttcatcccagcctgcaaacttcatcggcactttgtcgtaaaagcgggtttctgcaccttccatcacctgattgtcattgatgcggaaagagagcagtacggctttcttcagccactgatgcgttacccactcgccgtcgatcttctcagaaacgcgcagtgcaccgctgtccagcagggcgatcacctggttgatggcatcacgggtttcgctgtcgacgctggcgggtgtgatgtcagcgcgacgttcgaaggcggattcaataacgctctgtaactgttgcatatttttttcctgatctgtcatgtgcgatgccgggcaataccccgacacaagtaaagagattaatgtttacaaatcgagtctggtcacactttatcgtttggattaagggcctctgtcaaccgttgtcgcaacgcttttcgcatttcttcgtccagtgcctgacgttcactgttggccagaataaacaaatcttcgacccgctcgccgatggtgctgatgcgtgcgccatgcagtgagactccgagatcggcaaagacttcaccgacccgcgccagcaggcctggctgatccagcgccaccagttccagatagctgcgacgatcggtatgcgtcggcaggaaattgacctcggtatcgacgctgaaatgcctgagtttggccgacggacggcgggtacgcggcggcgcccactctgactgggttatcgcctgctccagcgcctgaatgatcattggatggcgatccggagagagcgggctgccatccggctccagcacaataaaggtatccatcgccatgccgtcgcggctggtaaagatttgcgcatcgtgcacgctgagattacggcgatcgagttcacctgccacggcggcaaacaggtgcgggcgatcgggactccagataaagatttcagtcccgccgcgcgtggcctgcggactgaccagcaccagcggttttttcaggtcgtgaaccagcaggtgacgggcatgccaggcgatctgattcggcgtatggcgcaggaaatagtcagcgcggcagcgattccagatctggtgcagacgctcttcatcaatgttgtccatccgcagcagcgccagcgcctgcaggcgatgatgacgcacccgctcacgcagatccggactgttttccatgccgcgtcgcaactgcttctcggtggcgaaaaagagctcacgcaacaggctctgcttccagctgttccacagactttcattggtggcacagatatcggctacggtcaggcaaaccagatagcgcagccggttctcattctgcatcacctcggcgaaactgctgtatcaccgtcgggtcctgaatatcgcgccgctgtgctgtcaccgacatcagcagatgatgacgcaccagccaggccaccagctgggtttcacgtgagttgagaccgtgcatttcagcaaagtcgagcgcatcctgcgcgccgagaatagagtgatcgccgccgcgccctttggcaatgtcatgcagcagcgcggccatcagcaacagctcctgttgcggcaggcgcggccataactcgacgcacagtggatgctgcgggcgggtgctttcattggcaaaactttccagcttctgcaacacccgaatggtgtgctcatctacggtgtaggcgtgaaacagatcgaactgcatctgtccgacgatatggccccacagcggcgtataagcccacagcacgctatagcgatgcattggcaccagcgcccggctgaccgcgccgggatggcgcagaatcgacataaaggtgcggcgcgcttccgggatctgacacagcggctgtttaagatgacgacgcgcatggcgcaggtgacgcagggtggtggagtagatccctttgatgctgtcgttacgcaccatgacgtagaacatgcgcaggatcgcctgcggctctcgccggaacagcgtttcgtcgcgcaggtcgatcaaatcgccacgcagctggaaatcgtcatcaataggcctgggcttttcgctggtggagagcgccagaatcgcctcatcaaacagctgcagcagcatctgattcagttcgccgatacgccgcgtgacccgatagaaatctttcatcatccgctcgaccggctcattgccctcgccctggtaattcaggcgttgtgccacgctgagctggcgatcgaacagcaggcgattatcgtagcggggcagggagaggtgcagggcaaagcggatgcgccagagaaatgcctgacattcgttgagttcgctgcgctcggcgtcggtgaggaaaccaaagccgaccatctcatccagcgtggtggcgccaaaatggcgtcgggcgacccactgcagcgtatgaatgtcccgcaggccaccggggctgcttttaatgtccggttcaaggttatagctggtgccgtggtaacgcttgtggcgctcctgctgctcttcaattttggcggcgaaaaagcaggatgagggccagaaaccatcgctgaagatgtttttctgtaattccagaaacagcgccacatcgccggtcagcatgcgtgactcaatcagattggtggcaacggtcaggtcagataacccctccagcaggcactcttccagcgtgcggacgctgtgacccacttccagcttaaggtcccacatcagcgttaacagatcgctggtgcgctgcgcagcctgttcattcagcggctggcggctcaggatcaggacgtcaatatcagagagtggatgcagctcggcacggccatagccgccaacggcgaccagcgcgatagccggcatctcatcaaagccaaaaaagcgccacaggcgacgcagcagccgatcgataaacagcgtgcgggcatcaatcagcggctcaacgggttcaccggcatcaaaagcggcggccagatgttgctgaaactgctccagccgcggcttcagaatgtcacgtgtcagctggtcgtcactccattcggctggcgaatcgaccagaccgtttttcacatcttctgacagactcacgctcatgcagctcttctcttttttagccaaaaaaaagccggctcagcgccggcttgatctgtaatgggggaattacccttcggcgacaagcactgcgggcagcgtgtcgtctttgcgcagggttaaaatctcacagccgttctccgtcaccacaatagtatgctcatactgcgcggacaagctgcgatctttggtttttaccgtccagccatctttcatggtgcggatgcggtaatccccggcattgaccatcggtttctaccgtaaaggtcatgcccgcctggagtaccacgccgccatcatcggcatcgtaatgcagcacctgaggctcttcatggaaacccttgccgataccgtggccgcaatattcgcgcaccacagagaaatcgttggcttcaacatatttctggatggcgcggcccagttcgcgcaggcggatgccgggcttgatcagacgcagtgagagatagaggctctcctgcgtgacacggcacaggcgttcgccctgaatggtcggcttaccgacgataaacatctttgaggtatcgccgtggtattcatctttaattacggtgacatcgatattcactacatcgccatcttttaacggacgatcatcgctggggatcccgtggcacaccacttcattcaccgagatgcagaccgacttcggaaagccgtgatagccgaggcaggcggagacggcctgttgcttttgagtaatgtgatcgtggcagatgcggtccagttcaccggtggtcacacccggttttacgtaaggctcgatcatctccagcacttcggcggccagtcggcccgcgacgcgcattttttcgatttcttcaggggttttaattgaaattgccattaaattaatccgcagttgtcgaaattttcgacaataataagttctgtgctgtcatgttagcagccagcaaatgggctgccaaatagagaacgcgctgacctccgtcagcgatcatttattggcgtccctgggctggttgtggtataaagcgcgccgacgattctctgtatggccgtttcggtcagcaggaaacgcataactctcattatgtgtaataaaacacacatgtatcgacacatacgccggggtgccttgaaagaggtcggtcgtatgggatacatggaggcccaaccccaatcaaactttagaggttttatcatggcaactgtttccatgcgcgacatgctccaggctggtgttcacttcggtcaccagacccgttactggaacccaaaaatgaagccattcatctttggtgctcgtaacaaggttcacatcatcaacctggaaaaaactgtacctatgttcaacgaagctctggctgaactgaacaagatctcttcccgtaaaggtaagatcctgatcgtaggtactaagcgtgctgctgctcaggcggtaaaagagtctgcactgagctgcgaccagtttcttcgtaaaccaccgctggttgggtggcatgctgactaactggaaaaccgtgcgtcagtcaatcaagcgtctgaaagatctggagattcagtctcaggatggtactttcgacaaactgaccaaaaaagaagcgctgatgcgtgcgcgtgagctggccaagctggaaaacagcctgggcggtatcaaagatatgggcggtctgccagacgcgctgtttgttgtcgatgctgaccacgaacacatcgcaatcaaagaagcaaacaacctgggtatcccggtatttgctatcgttgataccaactcagatccagatggcgttgatttcgttatcccaggtaacgacgatgcgatccgtgctgtaaacctgtacctgactgccgttgcgaccaccgttcgcgaaggccgctctcaggacctggctgagcaagctgaagaagcgtctttagaaaacgcttaataaggtttgctctgcataagagcccttagcattcagatgtgatctgtaaggggcctatactggcccctttattttatctaagtctgtcacgcccccaaccggacggcgggacagagtaaattttccgcaaataagtgtctgctggtgaaaacgtacacaggcacgaaccgaggattctggaatggctgacattaccgctgcattggtaaaagaactgcgtgagcgtactggcgctggcatgatggattgcaaaaaagcgctgactgaagcgaacggcgacattgagctggcgattgagaacatgcgtaagtctggcgcaatcaaagcagcgaaaaaagcaggcaacgttgctgctgatggcgtaatcaaaaccaagatcgttggcgactacggcgtgattctggaagtaaactgccagactgacttcgttgcaaaagatggcggtttccaggcgtttcgcagacaaagttctggatgtggctgcagctgatcgcgttaccgacgttgaagttctgaaagcgcagttcgaagaagagcgcgttgcactggttgctaaaatcggtgagaacatcaacatccgtcgcgttgctatcctggaaggcgcagagctgggcagctacctgcacggcgcacgtatcggcgttctggtttcaaccaaaggcgctaacgaagatctgatcaaacagatcgcgatgcacgttgcggcaagcaagcctgaattcgttaagccagaagacgtttctgctgacgtggttgataaagagtaccaggttcagctggacatcgcgatgcagtctggcaagccaaaagagatcgcagagaagatggttgaaggccgtatgaagaaattcaccggcgaagtctctctgactggtcaggctttcgttatcgacccaagcaaaaccgttggccaggctctgaaagagcagggcgctgacgttatcaacttcatccgcttcgaagttggtgaaggcatcgagaaagttgagtctgacttcgctgcagaagttgcagcaatgtccaaacagtcttaatgctttgaaagaaccgccagatggcggttcttttttgtctgtgaatcgcaacagacacgttttcagtttcatcccaatagcaatttcattgcggtaagcggatgatcgatcagaatttacttctcctttacacccaatcttccaggaagaactgaccatggcgaccaacgcaaaacctgtttatcaacgtatcctgcttaaactcagcggcgaagccctgcaaggcgctgaaggttttggtatcgacgcgagtgtgcttgaccgcatggcacaagaggtaaaagagctggttgaactgggcatccaggttggcgtggtgattggcggagggaacctgttccgtggagcgagcctgcagcaggccggcatgaaccgcgttgtgggtgaccacatgggtatgctggcaaccgtgatgaacggcctggcgatgcgtgatgcactgcaccgcgcctatgtgaatgcacgcctgatgtcagcgattccactgaatggcgtctgtgacaactacagctgggcagaagcaatcagcctgctgcgtaacaaccgcgtggtgatcttctccgccggtaccggtaacccgttcttcaccactgactctgcagcgtgtctgcgcggcattgagattgaagcggacgtcgtgctgaaagcgaccaaagtggacggcgtctactctgcggatccggtgaaaagcccggacgcaacgctgtatgagcaactgacctatgctgaagtgctggatcaggagctgaaagtgatggatcttgcggcctttaccctggcgcgtgaccacaaattacctatccgtgttttcaacatgaataagcctggcgcactgcgtcgcgtagtgatgggtgaaaaagaaggcaccctgattacgcattaatacccgaggcgagataaaataaggtatattctgtcagcgcgatgataatgcatcgcgcaccagtcaggattatcgatgattatcgatcccgcttccggttacgccggaaactggccaggtcaaaccgaatccaagggtttcaacgtgattaacgacatcaaaaaagatgctgacacgcgcatggaaaaatgcgttgaagcattcaaaaccaccatcagcaaagtgcgcaccggtcgtgcttcaccttcgctgctcgacggcatcgtcgtcgaatattacggcacgccgacgccactgcgtcagctggcttctgtcactgtggaagattcacgcacgctgaaaatcaacgtgtttgatcgttcactgagtccggcagtcgaaaaagcgatcatgaagtccgatctcggtctgaacccaagttcagccggtaccgacatccgtgttccgctgcctgcgctgacagaagagcgtcgtaaagatctgattaaaatcgtgcgcggcgaagccgagcagggccgtgtgtcggtacgtaacgtccgtcgcgatgccaacgataaaatcaaagcgctgctgaaagataaagagatcagcgaagacgacgaacgtcgtgcgcaggatgaagtgcaaaaaatgaccgatgcgtacatcaagaaagttgatgctgcactgtcagaaaaagagacggagctgatggatttctaatcccatcactgccggacaaaacgccgtacagagaggtattcgtatgaatgcgacatctggcggcgttttacattgtgcctgtgggtacgctgacttcacacggatagcttcatgaagcgattaactctgctgggatccaccggatcaatcggcaccagtacgctggcggtggtgcgcgccaacccggcgctttatcagattacggcgctggttgccggccataacgtggcgctgatggccgagcagtgtgcggcctttacaccgcgctacgcctgcatggcagacgaggcatccgccgctgcgttgcgtgagcgactgagagcaatcagggtcaatactgaagtgctctccggcgtttcaggcagcctgtgagctggccgcgctggatgaggtggatcaggtgatggcggcgatcgttggcgcatcgggtttgctgccgacgctggcggccattcgcgccggaaaaacggtgctgctggccaacaaagaatcgcttgtcacctgcggccgtttgtttatggaggccgtgcgtcatcataacgcacagttactaccggtcgacagcgagcataacgccatttttcagagtttaccggctaccatccagcatcagttaggttacgctgacctgcgggataatggcattgagtcgattatccttacgggatcgggtggtccttttcgtgacacagatttagcggatctcagcgccatgtcgccagatcaggcctgtgcacatccgaactggtcgatggggagaaaaatctctgtcgattcggccaccatgatgaataaaggtcttgagtacattgaagcccgttggttgtttaatgccagcgcagcgcagatggaagtgatactccacccacagtcggtgattcactccatggtgcgatactgcgatggcagcgtgctggctcaattaggttctcctgatatgcgtacgccgattgcccacagcatggcctggccttcgcgcatcaatgcaggcgtgacgccgctggattttacccgcatgtcggcgctctcctttgcagaacctgattttagtcgctacccctgtctgaaactggccattgatgcctgtgatgcagggcaggcggcgaccaccacgctgaatgcagccaacgaggttgccgtcgcggctttcctgaatcaccagatccgcttcaccgacattgccgcgcttaatagtgaggtgatggcggcacaagtgtgtccggagccggattcggtggacgctgtccttgaaatcgatcgcactgcgcgcgcgctggcgacagaaatgttgccgcgtttcacgtcgtgatgccgatcgttatgaggccatttgttcgcttcaggtgaaaatgatatagtcgctggctcgcgtttcacggtctgtcaccgaattcggtgtggcccggcactgagagtgtgtcgggatttgaatcgggcgcaatgtattcagaaaccacagcatttctgatgaaaggaattggttaagcgttatgtcgtctaacaatcacaacaacactgatgaccagcagggaaacggtccgcgccacgtcgctatcatcatggatggcaatggccgctgggccaaaaatcagggaaaattgcgcatttcaggccacaaagctggcgttaaatcggtacgccgtgccgtcagctttgcggtcagtaacaatcttgaagccctgacgctttacgccttcagcagtgaaaactggagtcgtccgccgcaggaagtcaccgcgttaatggaactctttgtctgggcgcttgatagtgaagtgaagagcctgcacaaacacaatgttcgcttacgcgtcattggcgataccagccgtttcagcccgcgtattcaggaacgtattcgccgttctgagacgctgaccgcaaataatagtggcctgacgctcaacattgctgccaactatggcggccgttgggatattatcgaaggcgtgaaaaaactggctgaacaggttcaggaaggattactgcgacctgaccagattaccgaagagagcctgacgtcgcagctctgtatgcaggagctggcgccagtggatttagtgataaggaccgggggagagcatcggattagcaacttcctgctgtggcagattgcctatgctgaattctattttaccgatgtgctctggccggatttcgatgaacacgtttttgaaggtgcactgaatgcattctctctgcgggagcgtcgttttggcggcgctgcaccaggcggcgcctgagcaatctgggggtaacctttgctgaagtctcgtctgattaccgcgttgatattaattccgctggtaatagctgcactgttctggttaccgcctgttggcttcgccctgacaaccatcgttatctgcatgctggcagcctgggaatggggtcagtttgcagggatggcatcacggcaacagcgcgtctggcttgctgtactttgtggtctgctgctggcgctgatgcagtttacgctgccaccttatcaacacacggtgcatctgccacagatcgcgacatcgctttgggcgtcgctggtgtggtgggtcgttgcactgctgctggtgctctcctatcccgcttctgcggccttctggcgccattcgcgtccccttcgcttactgtttggcgtgttaacgctggtcccttttttctggggcatggtggcgttgcgccagtatcactatgacaccgaccacttcgccggtgcctggtggctgctgtttgtgttgctgctggtgtggggagcggattcaggtgcctatatgtttggcaagatgtttggcaagcacaagctggcgccaaaggtctcaccaggcaaaacctgggaaggcttcctgggcggtctggtcacctcggcgctgattgcagtgctgtttgcgacgctggcgccactgacggtttccaccggtacgctggtgatttgcgcgattatcgcgacgctggcctccgtgctgggcgacctcactgagagcatgtttaaacgtgaagcgggcatcaaagacagtggtaatctgattcctggtcacggtggcattcttgatcgtattgatagtctgactgcggcggtgccggtgtttgcctgtttattgctgctggtgtttcgcaccctttaaggacaggcaaagatgttgagcatactctggagtttcgtcgcctttatcgttgcgctgggcgtattaattaccgttcatgagtttggccatttctgggtcgctcgtcgctgtggcgtcaaagttgagcgcttttccattggttttggtaagtcgctctggcagcgccgtgaccgccacggcaccgaatttgtcatcgcgctgattccccttggcggctacgttaaaatgctcgacgagcgtgttgaaagcgtgccagccgaatttcgtcatcaggcttttaacaacaaagccgtctggcaacgcgcctccatcattgcggcaggtcctgtcgctaatttcatctttgccatctttgcctactgggttgtgtttattcacggcgtgcccggcgtgcgcccggtaatcggtgaaattttaaacggttcggtggcttcggaagctcaaattacgcccggcatggaacttaaggctgttgacggtatcgaaacgcctgactgggatgctgtgcgtatggcgctggtgggtaaaatcggcgacagcagcaccaccttaacggtggctcgatttggcgaggacgcgacccagcagaaacagctggatttgcgtaactggcagtttgagcctgataagcaggatccggtcgtcgcgttagggattcagccacgcggtccgcagattgagaccacgctggcagaagtgcaggcgaaactcgccagccagtgaagccggtttgcaagcaggcgacaggatcgttaaagtcgatggtcagccattatcgcagtggcagacttttgtcatgcaggtccgggataaccccggcaaaagcatggcgcttgaggtggatcgcggcggtgagtctattgcgctgacgatgacgccagaagcgaaatctggcagtaaagcgggatttgcgggtgtcattccgcgcattgttcctctgccagaagagtacaagacggtaagacagtatggcgcgtttgcggctatcggtgaggctagtgtaaaaacctggcaactgatgaagctcaccgtctccatgctgggcaagttaataaccggtgatgtgaagctgaacaacctgagcgggccaatttcgattgcgcagggtgcagggttgtcagcagagtatgggttgatttactacctgatgttcctggcgttgattagcgtcaacctgggcatcatcaacctgttccctctgccggttttagatggtgggcacttgctcttcctggcgatcgaaaagatcaagggtggaccggtgtccgagcgagttcaggactttagttatcgcatcggttcaattttactggtgctgttaatggggcttgcacttttcaatgatttctcacgtttgtaaccgctggaacgcgaacattcgagggatgtgttaggaaaacgcataacaacgatggcgatgaaaaagttgctcatagcgtcgctgctgtttagcagcgccaccgtttacggtgcagacgatttcgtagtgaaggatattcatttcgaagggctgcagcgagtcgccgtcggcgcggctctgctgagcatgccagtacgggttggcgatacggtgaatgacgatgatgtcagaaataccattcgctcgctgttcgctactggcaactttgaggatgttcaggtcctgcgagacggtacaacgctgattgtccaggtcaaagaaacgtcctaccattgccagcattaccttcaccggtaacaaagcggtgaaagaggatcagctcaaacaaaatctggaagcctcaggtgtccgtgtcggcgaagcgctggaccgtaccaccatctcctctatcgagaagggacttgaggatttctactacagcgtaggtaaatataccgccaacgtgaaagccgtggtcacgccactgccgcgtaaccgtgtggatctgaagctggtctttactgaaggtgtctctgcaaaaattcagcagatcaacatcgtcggtaataaagcctttagctccgatgagctgatttcccgcttccagctgcgcgatgaagtgccatggtggaacgtggtcggcgatcgtaaatatcagaagcagaaactggcgggtgaccttgaaaccctgcgcagcttctatctggatcgtggctacgcacgctttaacatcgattcaacgcaggtcagtctgacgcctgataaaaaaggcatctacatcacggtgaacatcaccgaaggtgaccagtacaaaatcgctggcgtgatcgtcaatggcagcatggcgggccattcagcagaaattgaacatctgaccaagattccggcaggcgagctttataacggcgccaaagtcacgaaaatggaagatgacatcaagaaactgctgggccgctacggctatgcctatccgcgcgtggcaacacagccagaaatcaacgacgccgacaaaaccgtaaaactgcatattaatgtggatgcgggtaaccgttattatgtccgtaacgtccgtttcgaaggcaatgacacgtcgaaagactccgtgttacgtcgcgaaatgcgtcagatggaaggcgcgtggctgggcagcgatctggttgaacagggtaaagagcgcctgaaccgtaccggttactttgaaaccgtggatgtggatactcagcgtgtgccaggttcgccggaccaggttgacgtggtctacaaggttaaagaacgtaacaccggtacctttaacttcggcgtcggctacggcaccgaaagtggtgtgagcttccaggtcggcgtcacgcaggataactggctgggcaccggtaataccgtgggcatcagcgggaccaagaacgattaccagacctatgctgaattctcgctgactgacccttacttcaccgttgatggtgtcagtctgggtggtcgtctgttctacaacgactttaaagcagataacgcggacctttctgactataccaacaaaagttatggtctggatggcacgcttggcttcccggttaacgaaaacaacaccctgcgtgtcggtctgggctatgtccacaatgacctgtcaaacatgcagcctcaggtggcgatgtggcgttatcttgactcggtcggcaagccgcagcagctcaatgatgaaggtgatttctcagcagatgacttcacctttaactacggctggacttataacaccctggaccgcggcttcttcccgacgtccggtaaccgtaccaacctgaacggtaaggtgacgattccgggctcggataacagcttctataaggccacgctggatactcagcagtatgtgccgattaaccaggatcgtacctgggtgctgttaggccgtggtcgcgtaggttatggcgatggtctcgacggcaaagagatgccgttctacgagaacttctacgccggtggttcaagcaccgtgcgcggcttccagtccaacaccattggaccgaaagcagcctacttaaataacaactcgtcgaactgccgaatcgccgatccaaatggcgtctgtaagtctgacgatgcggtgggcggtaacgccatggcgattgccagccttgagctgattacgccaacgccgttcctgagcgagaagtatgctaactcggttcgtacctcggtgtttgtcgatgccggtacagcgtgggatacccattgggaaaataccgcagaaacgcgtgcggcgggcattcctgactacagcgatccaaacaatatccgtgtatccagcggtgttgcgctacagtggatgtcaccgctcggcccgctggtgttctcttacgcccagccgatgaagaaagtcgatggagacaagtcagagcagttccagtttaacattggtaaaacctggtaatgttctgagcatggatgcatagctgaagtattgctgccggacagcacctgttgctgttccggggcaaacactgtgtcgctgacacaaacgttgatggtaaggagtttatagtgaaaaagttgttgtgtgccgcaggtctgggtcttgctttagcggtctccgctggtgttcaggctgccgacaaaattgcagtggtaaacgtgtccagcattttccaacagttaccgcaacgtgcgactgttgctaaacagctggaaaacgagttcaaaggccgtgcaactgagttgcagagccaggagcgcgatctgcaaaccaaaatgcagcgtctgcagcgtgacggttttctaccatgaaggcgagcgaacgcagccgtatggaaaaagatgtcatgtctcagcgcgaagctttctctacaaaagcccagtcttttgagcaggataatcgccgtcgtcagatggaagagcgtaacaagctgctgagccgtattcaggatgccgtgaagaaagtcgctgacagcgatggttacgacgtcgtgatcgacgctaacgcggtggcttatgcgtcaaacgcaaaagacatcactgctgacgtgctgaaacaggttaaataattcatgtcatctattcgactggctgatttagcccagcagttggatgcagaattgcacggagatggcgatatcgtcatctccggcattgcttctatgcaatccgccacaactggccaaatcacttttcttgcaaacagccgttaccgcgagcaactcgccctgattaaggcctcagccgtggtgctgacggaagcggatctggagtggtgcaataccgcagcgctggtggtgaaagatccctacctgacctatgcgcgtatggcacaaatacttgataccacgccacagccagcgcaaaatattgcccccagtgcagtgatcgatccctcagcccgactcgggagcaacgtcgccattggcgccaatgcggtgatcgaagcggatgttgagctgggcgataacgtggtcattggtgcaggatgttttgttggcaaaaaaacccgtatcggcagcggtacccgtctctgggccaacgtctctgtttatcacgaaattgaaatcggtcaggattgcctgattcagtcaggtaccgtcatcggttctgatggtttcggctatgccaacgatcgtggtaactgggtgaaaatcccgcagttaggcgcggtgataatcggcgatcgcgtagaaataggtgcctgcaccactatcgatcgcggtgcgctggataacactctgatcggcaatggtgttatcatagacaaccagtgccagatcgctcacaacgtagttattggcgacaatactgcggttgcaggcggtgtgatcatggcgggtagtttgaaaattgggcgttactgtatgattggcggtgccagcgtcattaacggccatatggaaatctgtgacaaagtaacggtgaccggtatgggtatggtcatgcgtcctatcacagagcctggtgtctattcatcaggcattccgctgcaacccaacaaaacctggcgcaaaactgcagcgctggtgatgaacatcgatgacatgagcaaacgcttaaaagccatcgagcgcaaggtcggcaaagacgactaaccgccatcccaaaactgaccggctttcataataaaaatgttaagcagggaagcccggcgccacagaacctatttgcggcctgcggaagatcattttgatctgtgcaggccgtgttattgatgtcatcagatttttaggacaggaagagtattttgactactgaaactcatactctgaaaattgaagagattttagagctgctgccgcaccgctatccgtttctgctggtagaccgcgtgctggaatttgaagagcacaaatacctgcgtgcagtgaagaacgtttctgttaatgaaccgtttttccaggggcacttccctggtaaaccgatttttcctggcgttctgatcctggaagcgatggcgcaggctaccggtattctggcgtttaaaagcgtaggtaaactggagccaggcgaactctactactttgccggtatcgacagtgcccgtttcaagcgccctgtggtaccaggcgaccaaatgatcatggaagtcactttcgagaaaacccgccgtggtctaacccgctttaaaggcgtggcgaccgtcgacggtaaaatcgtttgtgaagcgaccatgatgtgtgcccgcagccgggaggcataattcgtgattgatccaacagccactatccatcccagtttctgtcatcgaagagggcgctattattggcgcccgcgttcacattggcccgttttgctttattggtgcgaatgttgagatcggtgaaggaacggtactgaagtcacatgttgtggtgaacggccacacgcgcatcggtaaagataatcagatttatcagttcgcctcaattggcgaagtgaatcaggatctgaaatatgccggtgagccaacacgggttgagatcggtgatcgtaaccgcatccgtgaaagcgtgacgattcatcgcggcaccacgcagggtggccaggtcaccacagtgggcagcgataatctgctgatggttaatgctcacatcgcgcatgactgcgtgattggcaaccgctgtatcttcgccaacaacgccaccctgggtggtcacgtgacggtcgatgatttcgccattattggcggcatgacagcggtacatcagtggtgcatcatcggtgctcacgtgatggttggcggctgttcgggcgtggcgcaggatgtgccgccttacgttattgcgcagggcaaccacgctacgccgttcgggatcaatatcgaaggtctcaagcgtcgtggcttcagcaaagagtcgttgcacgctatccgcaacgcctacaagttgctctatcgcagcggcagaacgctggaggaagtgaaaccggagatcgaagccatcgcacagcagcacagcgaagtgcaacctttctacgatttcttcacccgttcaacccgtggattaattcgttaatccatgtcagcgcgtcccttaacgattgccctggtcgccggagaaacctccggcgatattcttggtgcaggtctgatccgtgccctgaaagcccgtcatccggatgcacgctttgtcggcgtggcgggtcccctgatgcaggcagaagggtgtgaagcctggtatgagatggaagagctggcggtgatgggcattgtcgaggtgctcggtcgccttcgacgcctgctgacaatccgtcgcgatctcacccggcgttttaccgaaactccgacccgatgtctttgtcgggattgatgcgcccgatttcaatatcaccctggaaggcaatcttaaacgcactggcattcgcactatccactatgtcagcccctcggtgtgggcatggcggcaaaagcgtgtctttaagattggtcgtaacaccgacctggtgctggcgttcctgccatttgaaaaagctttttacgatcgctataacgttccctgtcgttttatcggtcacaccatggcggatgccatgccgctgcaacccgataagctggctgcacgccgtcatctgggcattgccgatgatgcgctctgcctggccttgctgcccggcagccggggtgcggaagtggaaatgctcagcgccgattttctgaaaaccgctcagttgctgcgtcgtcactatccggcgctggaaatcgtggtgccgctggtcaacgcccgtcgccgcgaacagtttgagaagattaaagccgaaaccgcccccgaactgccgatgcatctgcttgatggtcagggacgtgaggcgatgattgcgagcgatgccgcactcctggcgtcaggcactgccgcactggagtgcatgctggcaaaatgcccaatggtcgtcggttatcgcatgaagccggccaccttctggctggcgaaacggctggtcaaaaccccttacgtctcgctgccaaacctgctggcagggcgtgagctggtcaaagagttactgcaggatgagtgtcagcctgaagccctggccgcagcgttagatccgctgctgcatgccgggcctgagcgagaaacactcttgcagacgtttcatgaattacatcaacagatccgctggaacgccgatgagcaggcagcggatgcggtactggagctggtgaatgcctgattttatctatcctgtcgccagactgattgccggtgtggacgaagtggggcgcggtccgctggttggcgcggtcgttactgccgcggtgatcctcgatccggcaaacccgattaccggcctggccgactcgaagaaactgtctgaaaagcgccgcctcgcgttgtatgacgaaatcaaagagaaagcgctggcatggagtctgggacgcgcagagcctgaagagatcgatcagctcaacattctgcatgccactatgctggcgatgcagcgcgccgtagctggccttggcattcagcccgattatgtgctgattgatggtaatcgttgcccggcattgccaatgccttcacaggcggtagttaaaggggatagtctggttgccgaaatcagtgcagcatcgatcatcgccaaagtgtcgcgtgaccaggagatgaccgaactcgatctgctgttcccgcagtatggttttgcgcagcacaaaggttatccgacggcgctgcatatggaaaaactgacgcagtatggcgtcacgccgcaccaccgtcgcagttttgcgcccgtacgcaatgcgctgctcgatgctgaagtactggctgcacgccagacccttacgctttaatagcctgacgctgttttaaccggaaactgatatggctgaaccccgttttatacatctgcgtgtccacagtgactattcgatgattgatggcctggcgaaaaccgggccgttaatcaagaaggcggcagcccttggcatgccggctatcgcgattaccgacttcactaacctctgtggcctggtgaaattttacggtggcgcacatagcgcagggataaagccggtcattggtgccgatttcaacgttgccagtgagctaatgggggatgaactgacacagcttactgtgctggcgtccagtaataccggatatcagaacctgacgctgctgatctcccgtgcctatcagcgtgggtatggcgtggacggaccgatcatcgaccgcgactggctgattgaattgcaggaaggattaatcctgctgtcgggcggacggcgcggcgatgtgggtcgcagcctgctgcgcggcaacaatgccctggtttcgcaatgcctgtcgttttaccagcaacatttccccgatcgctattacctggagctgattcgtaccggccgtcaggacgaagagagctatctgcatgcggcagttgaactggcgattgcagagggaataccggtggttgccaccaatgaagtctgctttatcaatgcagaagatttcgatgcgcacgaaattcgcgttgccattcatgatggctatacgctggatgatcccaagcgtccgcgtaactacagtcctcagcaatatatgcgcagcgaagaggagatgtgcgagctcttctcggacatcccggaagcgctggaaaacagcgtagagattgctaagcgttgtaacgtcacggtccgactgggcgagtacttcctgccgcagttcccgaccggtgacatgaccaccgaagattatctggtggtgaaatcccgtgagggtctggaagagcgtctcgagttcctgttcccggacgaagccgaaacgccttgagaaacgcccggaatatgatgaacgtctggagattgaactcaacgttattaaccagatgggtttccccggctacttcctgatcgtaatggagttcatccagtggtccaaggacaacggcgtgccggtcgggccggggcgtggttccggtgccggttcgctggtggcctatgcgctgaaaatcaccgatatcgatccgctggaatttgacctgctgttcgaacgcttcctgaacccggaacgcgtctcgatgcccgatttcgacgtcgacttctgcatggagaagcgcgatcaggtgatcgaacacgttgcagatatgtacggacgtgaagcggtttcccagattattaccttcggcaccatggcggcgaaagcggtcattcgcgatgtgggccgcgtgctgggacatccttacggcttcgttgaccgcatttcaaaactgatcccgcccgatcccggcatgacgctggaaaaagcttttattgctgaaccgcagcttcccgccatgtatgacgcggacgaagaggttaaagcgctgatcgacatggcgcgcaagctggaaggggtcacgcgtaacgccggtaaacatgcgggcggcgtggtcattgcgccaacgaagatcaccgattttgcgccgctctattgcgatgagcatgggcagttcccggtaactcagttcgataaaaatgatgtggaatatgccggcctggtgaagttcgacttcctgggtctgcgtacgctgaccatcatcgactgggcgctgaagatgatcaacccgcgccgggaaaagcaggggctggagccgatcgatatcgcctctatcccgctggacgataagaaaagcttcgatatgctgcagcgctcggaaaccactgcggtgttccagcttgaatcgcgcggcatgaaagatctgattaagcgtctgaagcccgactgcttcgaagatatgatcgcactggtggcgctgttccgtcctggcccactgcagtccggcatggtggataacttcattgaccgtaagcatggccgtgaagcgatctcctatcccgacattcagtggcagcacgaaagcctgaaaccggtgctggaaccgacctacggcatcatcctttatcaggaacaggtgatgcagatcgcccaggttttctctccggttacacgctgggcggtgcggatatgctgcgtcgcgccatgggtaaaaagaaacccgaggagatggccaaacagcgttctgtattccgcgacggtgccgaaagtatgggcatcgacggggaactgtcgatgaagatcttcgatctggtagaaaaatttgcaggttatggctttaacaagtcacactctgcggcctacgcactcgtctcctaccagacgttgtggctgaaggcgcactatccggctgagtttatggctgcggtcatgaccgccgatatggataacaccgagaaagtggttggcctggtcgatgagtgctggcggatgggactgaaagtcctgccgcctgatatcaactccggtctctatcagttccatgttaatgacgcgggcgagatcgtttacggtatcggcgcgatcaaaggcgtcggtgaaggcccgatcgaagcgatcatcgacgcccgtaacgaaggcggttatttccgcgagttgtttgatctctgcgcccgtaccgacaccaaaaagatcaaccgtcgggtaatggaaaaattgatcatgtccggggcctttgatcgccttggaccgcatcgcgctgcgctgatgagttcactcagtgacgcgttaaaagcggccgatcagcacgcgaaagcggaagcgattggccaggctgatatgtttggcgtactggcggaagagccggagcaggttgagaaatcgtacgccagcgtcacgccgtggcctgagcaggtgcagctggatggcgaacgggaaacgctggggctttaccttaccggccacccgattaatcagtacctgaaagaaattgagcgttatgttggcggggtgcggctgaaagatatgcatcctaccgatcggggtaaaattaccgtggcggccggtctggtgatcgcggcacgggtaatggtcaccaaacgcggcaaccgaattggtatctgtactctggacgatcgctccggtcgtcttgaggtgatgttatttaccgatgcgttagataaataccagcagttgctggagaaagaccgaattctgatcgtcagcggacaggtcagctttgatgacttcagtggtggccttaaaatgaccgctcgtgaagtcatggacatcaacgaagctcgcgaaaaatacgcgcgcggacttgctatctcgctgacggacaggcaaattgatgaccagctattaaaccgactccgtcagtctctggaacctcatcgatcagggactattccggtgcatctctactatcagagagccgacgcgcgagcgaagctgcgctttggtgcagcgtggcgaatttcgcccagcgatcgtttacttaacgatctgcgctcgttgattggatcggagcaggtggaactggagtttgactagaacaggaacattatgagtcttaattacctggattttgaacagccaattgcagaactggaagcgaagatcgattcgctgacctcaattggtcgtcaggatgataaacacgttaatctggatgaagaagttcagcgtctgcgtgagaaaagcgttgagctgacccgtaagatcttcgccgatttgggcgcatggcaaatcgctcagctggcgcgtcatcctttgcgtccttacacctttgactacgtgcgcaacgccttcgacgatttcgatgagctggcgggcgaccgtgcttatgccgatgacaaagcgattgtgggcggcattgcacgtcttgatggacgtccggtgatgatcatcgggcaccagaaaggccgtgaaaccaaagagaaaattcgccgtaacttcggcatgccagcaccggaaggctatcgcaaagcgctgcgcctgatggagatggctgagcgtttcaaaatgccaatcatcaccttcatcgacacaccgggtgcctatccgggtgtgggcgcggaagagcgtgggcagtctgaagcgattgcccgcaacctgcgtgaaatgtctggcctgaaagtgccggtgatctgtacggtcatcggtgagggtggttcaggtggtgcgctggcgattggcgtgggcgacaaagtgaatatgctgcagtacagcacctattcagtgatctcgccggaaggctgtgcatctattctgtggaaaagcgctgacaaagcgccgctggccgctgaagcgatgggcattaccgctcaccgtctgaaagagctgaagctgattgactccgtgatccctgagccgctgggtggcgcgcatcgccgtccggttgatatggcgcagtcactgaagcagcagctgctggccgatctggccgatctcgatggatttagcactgaagagctgctggatcgtcgttatcagcgcctgatgagctacggctacgcctgatttagccccatcaataaaagcggactccggtccgctttttttatgccgccggtttatctccgcacgctattcccctctctttcagcgccatccgatagccgccttgctacaccttccgcgggttagcggttatgcttgtccggttccacaataatcagggagatgggcattgaatattctggcgatcatgggcgcgcacggcgtgttttataaagatgaaccgttacgcgaactcgacgcggcgttaaatctgcaaggcttcaggctgctttacccgaaaaacagtgacgatctgctgaaactgatcgagcacaatccgcgtatcagcggcgtcatcttcgactgggacgcgcacaacagtccggaactctgcggtgagattaatcagctcaacgaatacctgccgctgtacgcctttatcaacacccactcgcagatggatatcagcgtcaatgagatgcgtatgccgctgcacttttttgagtacgcgctgaatgccgccgacgatatcgcgctgcatatccggcaatataccgatgactatctcgaccacattacgccaccgctgactaaagcgttgttcacctatgtgaaagagggcaagtacaccttctgcacgccgggccatatggcgggtaccgcgtttcagaagagcccggtgggctgcctgttctacgatttcttcggggccaataccctgaaatcggacatctcaatttccgttaccgaactgggttcgctgcttgatcacaccggtccgcaccttgaagcggaggagtacattgcacgcacttttggcgccgaacagagttacatggtgaccaacgggacctcaacgtcgaacaaaattgtcggcatgtatgccgcaccggcgggcagcaccgtgctgatcgatcgcaactgccacaagtcactgacccatctgctgatgatgagtgatcttatccccatctggctgaagccgacccgcaatgcattgggtattctcggcggtatcccgaagcaggagttcacccgcgagagtatttcgcccaaggtggctgccaccgaccgtgccacgtggccggttcatgcggtgatcaccaactccacctatgatgggctgctctacaatacccagtacatcaaagagacactggatgtaccgtcgattcatttcgattcagcgtgggtgccttacaccaatttccatccgatctacgccggtaaaagtggcatgagtggcgaccgcatcccgggcaaagtggtgtatgagacgcaatcgacccacaaactgctggcggcgttttcgcaggcatcaatgattcacattaagggcgactacgacgaacagacgtttaacgaagcctacatgatgcacaccaccacctcgcccaattacgccatcgtctcctctattgaaactgctgctgccatgctgcgtggcaatcccggtaaacgactgatcaatcgctcggtggagcgcgcgctgcacttccgtcgggagatccagcgcctgcgcgaagagtccgacagctggttctttgatatctggcagccggaagaggttgatgaagcgcaatgctggccgatccagcccggcgacgaagagtggcacggatttactcaggccgatcgcgatcatatgtacctggatccgatcaaagtcaccattctgacgccgggcatgagcgaactggggaagatggcggaagaggggatcccggcggcgctggtggcgaagtttctggatgagcgcggcatcgtggtggagaaaaccggtccctataacctgctgttcctgttcagcatcggcatcgacaaaaccaaagcaatgagcgtgctgcgcgggctgaccgagttcaaacgcgcctacgatctcaatctgcgggtgaaaaacatgctgccggatctctatgccgaagatcctgacttctatcgcaatatgcgcatccagacactggcgcaggggatccatcagttgatccgccatcacgatctgccgcgtctgatgctgcaggcatttgatgtcctgcccgaaatgaagatgacgccgcatcaggcatttcagcagcaggtgaagggcaacatcgaaacggtggatctcagcgaactggtcgggcgggtgtcggccaatatgattctgccttatccgccaggcgttccactggtgatgccaggcgagatgattactgagaagagccgcgcggtgctcgattttctgctgatgctgtgcagcattggacggcattatccgggcttcgaaacggatattcacggtgccagcctgaccgaagagggcgagtatcgcgtccgcgtgctgaaaaacgacctcgcataaatctttaaacaactatcagcggcagggtgtctgcggacagcctgcccgaatcagggaattgaacatgttgcagttaaccgctattcaccacatcgccatcatcgcctctgactatcagcgcagcaaagcattctattgtgatgtactgggtttccgtctgatgggcgagtattaccgcgaagcgcgggactcctggaaaggcgaccttgccctacaggatcgctataccattgagctgttctcttttcctgagccgccggcgcgggtcagccatcccgaggcgtgtggcctgcgtcatctggcctttagcgtgccggatgttgccgctgccgtcgcgacgctggccgataaaggcgttatctgcgagccgattcgcattgatgacctgaccggtaaacaatgcactttctttgccgatccggatggtttgccgctggagctttatcaggcgtaaaatagcgcgctcagcgggcgacattcagtggcccgattttctggattctgccatgtctttgcccgcttttgacactctgttgcaatctgatgccgccctggtggtcgcattcagcggtggactggattcaaccgtgctgctacatcagcttcgcggctggcagcagcagcatcctcagttgcgcctgcgggcactgcatgttcaccatgggcttagcccgaatgccgatcgctgggcaacccattgccagacgatttgcgcgcagtggcagctgccctgtgaagtgctccgcgttaacgttgatggccgggaaaacggcattgaagcggccgcccgcaccgctcgttatcaggcgctgagtgcggcactgcagccgggcgaagtgttactcactgcgcagcacctcgacgatcagtgcgaaacattcctgctggcgctgaagcgcggcagcggtcccgccgggctggcagcgatgcccgctacacgcgcgctgggttctcatcagctggtgcgtccgctgctgaatcagacgcgacagtcgcttgaagcctatgccgacgcgcatcagctggtgtggattgaagatgagagcaatcaggatcttcgctacgaccgcaactttctacgtcagcggctgctgcctgagctttaccagcgctggccccattttgccgaagcaacggcccgcagtgcggcgttgtgcagtgagcaggagcagttgctggatgaactgctcgccgggcaactggctgagctgatccagcctgatggcagcctgtactttccacccttaatggccatgagtgagctacgtgctaatgccttattgcgccgctggatcgccggacagggtggggcgatgccgtcccgtgaagcgctgaaacgcatccacgacgaagtgatggcgagccgggaggatgcgcagccccggctgcgattcggtcaggctgaactccgtcgttaccgtcagcagctctactggctgccgttgctcagttcactgcgcgacaccgagctggcatggcccgatctctgtcagccgctggcgttaccacagaaccttggcacgctgcgtgccagccagtcgcagagcctgttgcgctatccagagccggatgagcaggtcagcgtgcggtttcacgcacagggttatgtccatctggtaggccgtcgtggcggaagggaaatgaaaaaactgtggcaggagttacagataccgccgtggcagcgtgaacggctgccgttaattttttataaccagacgctggtctgcgttccgactctctttgtcacctgtgatggcgcggcctctgatcagcagggctggcagatagtctgggacggggcatccggcgcaggagaacaacaataatgaaacagtggcttatcgcctgtttagcggtcaccgtgttaccggcatgggcagcgggtgatgcgcagcgcggcgcacagaaagcgggcagttgcatggcctgtcatggcgcagcgggaaaagcggcggtgccgctctatcctgacctggccgggcagcacgcaccttatctggaacatgcgctgcaggcctataaaaagggcgaacgcagtggcggtcaggctgaagtcatgaaagcatttgtggcgggattgagtgacagcgatatggcggatttagcggcgtactacagttcgttacagccctgaagtttaacagggcggaaaggtcccgccctgaatgcgtaggttactctgcgctgacaaccaccgtacccaactcgggatgggtgaagctggcgatatggtcgagacgtaattcgcgatgttcaccggaaagatcgatagccagatattcaacgttcttacgtgaaaagatctctttggcttttgccttaagctgctcgccatctttcatttccagcgacagcatccagttgttctggcaggcgagttccagattatcgtaatcatcgcaattgataggttggtacgcttcatttatcaacatagtcgctcaccaataagttagcagcggcgtaggccgcctgtttccctgacagaagagtttagctcagtatttgcggcaacatcattaagtgccttcaatgcgcagccaatcgcatccggtatgtaacctaaatccccgctgccgatttcggcatacttccggcgaactaactcacaataattttgcacgtggccctcctcggcagagcgtaaatactctggttaactggcgactatatcatagccatttagaggaaatcagcctgcgtaaagcaggaacagtgcgcgaatcactgctaaagtgacagattccgctgtctgaggcggaataaatcagagcacaaaaggttaatttgatgaacaggttatcggaggtcaacgtggttaaggtgtggggagcgagcttatgattatgctatcccgttcggttgagattccggagagtgagattgagctgacggcgattcgtgctcagggcgcaggcggacaacatgtcaataaagccagcaccgccattcatctgcgcttcgatatcgctgcctcttcactgcccgcgttttataaagagcggctgctcaccgccactcatcatttgattaccggtgatggcgttgtagtgatcaaggcgcaggagtatcgcagtcaggagatgaatcgtgaagcggcgctgcaacgtctggttaatctgatccaggagctgagtaccgtggaaaaagcccggcgcgccacgcggccgacccgcgcctcaaaagagcgccgtctggaaggaaaagcccgccgcagttcaactaaatcgatgcgcggcaaggtacaataaaaaacgccccgcaggcggggcgtttgagtacttacaacgtcaggggcgagcggcgaagagatcgagcctgctcagggaacggggtcagatctgaaagtcgctaaagccatccatggccgctcggcccgcaccgtccctggcgcgggacgctttcctctcctgacccggttcccttcgcgttgagctcatctgttgcggccagattcagcccgctttgattaacgctaagaacttacttattcagagccttcagcaggaattcaacaatttcatcctgcttaatcatctgcttctcaccggcacgacgtgatttgtactcaatctcctgattatcgagattgcgatcaccaatgacgatggtgtgtggcacaccgatcagttccatatcagcgaacatcacgcccggacgctctttacggtcatccagaataacctcaacgcctttagcacgcagggtggcatacagctcttccgccagctctttaacccggaacgatttctgcatattcattggcagaatcgcaacctcgaaaggtgccagtgcggctggccagataatgccgcggtcgtcatggttctgctcaatggctgccgcaacaacgcgggtgatgccgatgccgtagcagcccatgctcatcacctgattgcggccatcttcgccctgaacagacgctttcagcgcgtcagaatacttggtgccgagctggaaaatatgaccgacttcgatgccgcgcttaatctgcagcgtgcctttaccatccgggcttaaatcgccttcgaccacgttacggatatccgcaacgctggccagcggcagatcgcgctcccagttaatgccgaagtagtgcttaccatcgacgttggcaccggcgctgaagtcgctcatcttcgccacggtacggtcagcaatcacaggcatctgcagaccaaccgggccgattgaacccggtccggcacccactgcggcgcgaatctcttcttcggtcgcgaacaccagcggtgatgcaacgatctctgacttctccgctttgatctcattaagctgatgatcgccgcgtaccagcagggcaaccagcgcgtggccgctctcttcagcacctttaacaatcagcgttttcactgttttttcaacaggcacactgaattgctcaaccagctccgcgatggtttttgcgtctggcgtctcgaccagttgcatctcctgcgacggcgctgcgcgctcaccggcgggtgcgacggcttcggccagctcaatgttggccgcgtaatcagaatcggtagagaagatcacatcatcttcaccgctctgcgccagaaacctggaactcatgggaggcgctgccgccaatcgagccggtgtcggcctgcacggcgcggaaatccagacccatacggctgaagatctggctataggcgcggtacatcgcgtcatacgtttcctgcagcgattcctgcgaaacgtggaacgagtaagcatctttcatgatgaattcacgtgaacgcatcacgccaaagcgcggacggacttcatcacggaatttggtctggatctgatagaggttgagcggcagttgcttataagagctcagctcattgcggatcaggtcagtgaccacctcttcatgcgtcggacccagcacgaacggacgctcgtggcgatctgcaatacgtaacagttccgggccatactcctcccagcgaccgctctcctgccacaggtcggcgggctgcacaaccggcattaaaatctcaaccgcgcccgcgttgttcatctcttcgcgcacgatgttttcgacttttttcagcacgcgaaccccggtcggtaaccaggtgtacaagccagaagccagtttgcggatcataccggcgcgcagcatcagctggtggctgatcacttcagcgtcggaaggcgtctctttctgagtagagagcagatattgagtagtacgcattgattacggttccagttgatcggaaagtcacagacagaattttgctggcggctagtgtaccagtgagatcaccggctcaaaagcgggttttaacgcgggtcgatggcgatcacttcagtaccggcatcgtcaatgcgccagcgtacattaaaatccatcagccaggccgcatattcccgcgcctgtgtctcgccctgacggtaagcgggacggggatcctgtgccagcacttcactgataaagcgagccagattggggtagcgcgactgctggtgaagctgctgttgtgccagcgcggagaagcgaaccggcatatcagccgcaggtgccgcctgagcaaaacccgcctgggcatgcggcaatgcttcggcaaagggcagataaggtttgatatccaccaccggggtgccatcgaccagatccagactgccaagctgcaggatcacctgctgtttttcaatcctgataccttttagctcaaccagcgacatgccaatgggattgggacggaacgttgaacgtgtcgcaaatacacccatgcgcgcattgccgcccagccggggagggcgaaccgtgggacgccagccgccctccatcgtctgatggaagacaaacagcagccagaggtggctgaacgcttccagtccacgcaccgcttccggctgattgtaaggtggctgcaggtgcagttcgccgcccccatcctgcaccagccctggctggcgcggcacggcaaacttctccttccatggtgagcggattaccccaatttgcgcaaaggcaaattcactcattgattgctgactttcagtgccgaaccctgacacaccgcctgacgatagcagcctggcgtgccggtgacgatttcacactgatgcagcagcaccgcattggctttcatctgtgacgctttgatctgcagacgtttacgtgcagtagcgatgttggctggggagttctgattactcatctggcaatcttcagcggagacttcacccagatcgcggaaacggcttgctgaccagatcggcggcatcagtatagagcttaaccggtgccggtcgtgacacaggcttgcgggtgggttcactggattgctgcggccgggacggtgcgctgcttatcgggtgatactcatgaacacaccctgtcagcatcaatgctaacaagcagagcggtaaaaaacgcatggcaacatcctcaggtttcaaaaagtggcgttattgaaacaaggacaagaataaataacaagtcgggcagggcacccaataacagaaagggcggcatagcgccgcccttaaggagatgaacagctgaattaccagcctttaaccgcgccgccgttaaagactttgttagcggcatcgtagacttcgtcagactgataagccttgacaaatttcttcacgttttccgcatctttattatcttcgcgcgccacaatcaggttcacgtacggtgaatctttatcttcgacgaaaataccatctttggctggtgtcaggccaatctggctggcgtaggtggtgttgataaccgccagcgcgatctgctgatcgtccagtgagcgtggcagctgcggcgcttccagctcaacaattttcagatgcttagggttttcagtgatatccagcgaggttggcagcaggcccacgccatctttcagcttgatcagacccactttctgcagcagcagcagcgtacggcccaggttggtcgggtcgtttggaatggcaacctgagcgccatcctgcagctcatccagtgacttaatctttttcgaatagcccgcgattgggtagacgaaggagttacccactgaaaccagcttgtagccacgatctttgatctgctgatccagatacggtttgtgctggaaggcgttgacgtcgatatcgcctttgctcagtgcttcattcggcagtacgtaatcgttgaaggtgaccagctcaacgtccagaccatatttctctttggcaactttctgcgctgcttcagcaacctgctgctcagcaccgacaatcacacccactttgatgtggttagggtctttctctttttgatcgcatcctgccagcgcaatcgcgccaatcagtgcacccacagcggcaattttcttgaatctgaaagacatatcctttccttcttaataatgtgatattgctggcttatttatgggacaccgcacgcacgatgcggtcgccacagaattgaatgagatacaccaaaaccactaacaacaccaataccgtattcatcacagtggcgttatatccgatataaccatactgataaccgatctggcccagaccaccggcacccaccgcgccacccatggcggagtaaccaaccagggtaatcagggtgatggtcgcagcattcaccaggccaggcatcgcttccggcagcagaaccttacggatgatctgcattggcgtagcgcccatggcacgtgacgcttcaatcagtccggttggcagttccagcaaggcattttcaaccatacgtgcgataaacggtgccgcgcctacggtcaacggcacgatagccgcctgcagtccgattgaggtgccgacgattacgcgagtaaaaggaatcatccagaccagtaagataatgaaaggaatggagcggaagatattcaccagcgcggagagcacgcgataaagtccctgattctgcagaatctggcccggacgggtgacatagagtaaaacgccgaccggcagacccagcacaaaaccgaaaaagcccgagacgaaggtcatcatcagcgtttcccacacgccccgtcccagcaaccacatcatcgcttcagacataacctaacacctctactttcacatgattctccttcagccaggctatcgcctcgcgggtatcgctttctgtgccgtgcatttcggccagcataatgccgaacttcacgccaccggcgtaatccatctgggcactgataatgttgttattcacgttgtaacggcgggcagcttcagacagcagcggcgcatcaaccgatttaccggtgaattccagtcgcagcaggggcacggtgccttcagcggcggtggcagaaaggcgctgctggtaatcatccggaatatccagatgcagcgtagactgaataaactgctgcgccagcggtgtcttaggatgagagaagacctcactgacgctatctttctcaatcagttcaccgtgactgatgaccgcaacctgatcgcagatgcgtttcactacatccatttcatgagtgatcagcagaatcgtcagcccaagccggcggttaatgtctttaagcaattccagaatagagcgggtcgtcgcgggatccagtgcgctggtggcttcatcacacagcagaaaccttgggattgctggccagggcgcgggcaatcgcgacacgctgcttctgtccgcccgacagattggcgggccaggcatcatgcttgtctgataatcccaccagttccagcagttcagttacgcgagccgtgatctgagcgcgggagagattaccgagttccagtggaagagagacgttacccgcgacggtacgggagttcatcagattaaagtgctggaagatcatgccgatctggcggcgcgcctgggttaactgacgttcgttgagtgcggttaaatcagcaccgtctaccagtacgcggcccgaagtagggcgctccagcaggttaacgcaacgaatcaacgtacttttaccggcaccggaagcgccgataacgccataaatctgtccggcaggcacgtgcaggctgacatccgttagcgccggaacagaccgcgtaccttgctgaaacaccttggtaatattttctagtttaatcattatgttatttattatcgtgttgcgttgtccgtggtgtgggaagcctcgtcgcttttattcggtataaaagctggatggatgttaaggcatccagacgtctaaatcaatggaagtgattcaatctgacattctcccttttatagcaatcatgcgatactgatcggcaatttttacagcaggagtttctacgtggcgaataaagtccccgctatttttcttgatcgtgatggcacccttaatgtcgacaatggctatgtccatgagatcgatgacttccagtttattgacggcacgattgaagcgctgcaacaacttaagacaatgggttttgcgctggtggtcgtgaccaatcagtctggcatcgcgcgcggtatgtttactgaagatacctttatgcggctgacagaatggatggactggtcgctggccgatcgcgatgttgatcttgatggcatctatttctgtcctcaccatcctgaagcaacagtagcagagtttccgtcaggcctgtgactgccgcaagcctcagccgggtatgctgctgacggcgcaggaagaactgaatattgatatggccgcttcttatatggtgggtgacaagctggaagatatgctggcagggcaggctgccggtgtcggcaagaaagtactggtgcgcagcggcaaaccggtcactgctgaaggtgaagcagcagcagattgggtgattaatagcctggcagagcttccggcgcgcattaaaaaggggtaaaacggcgcttttgtgcaaatttcagacgaacagaaaaaaagtctcaatttgcacttgcgctatctgagccgttccctataatgcgcctccactgacacggcaaaccggaaacggaaaacgggtcaggaggcacaggagaatgcgccgccggagaaaaacttctgagaaagaggttgactctgcaggaggaaagcgtaatatacgccacctcgcgacaggacgctaacgcactgttcgcactgctctttaacaatttatcagacaatctgtgtgggcactcgcaggattgatatcagcgtctccggacgtaaaaaatatcaagcctcacgagtgaacacataatgaaattcattatgacgttttacagatgagcaccgcttaacttgtttaagcaaatcaaacttaaattgaagagtttgatcatggctcagattgaacgctggcggcaggcctaacacatgcaagtcggacggtagcacagagagcttgctctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaacttagcagagatgctttggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaagataccttcccgcgcagtgtccacacagattgtctgataaaaagtaatgagcaggacggctgcgaagtcgtgacacttttgtgtccccttcgtctagcggttaggactccgccctttcacggcggcaacaggggttcgaatcccctaggggacgccacctgcttggtgacaggtgaaaggtgtctccatacagtatctcaaaaccgatttggttgcgtaagcaaccgggccgcgtttgagatatttgctctttaacaatccggaacaagctgaaaattgaaacgacgcagcgcgtcattcctccgtaatagggaatgacaaagcgatgcgttcgagtctctcaaatgcttgcagcacgcagcgttgtaaaacgcctgtgggttgtgaggttaagcgactaagcgtacacggtggatgcccaggcagtcagaggcgatgaaggacgtgctaatctgcgtaaagcgacggtaaggtgatatgaaccgctacagccgtcgatgtccgaatggggaaacccggtgcactctgtgcatcattgcagcatgaatacatagtgctgcaaggcgaaccgggggaactgaaacatctaagtaccccgaggaaaagaaatcaaccgagattcccccagtagcggcgagcgaacggggagcagcccagagcctgaatcagcttgtgtgttagtggaagcgtctggaaagtcgcagggtacagggtgatactcccgtacacaaaagcacacatgctgtgagctcgatgagtaaggcgggacacgtggtatcctgtctgaatatggggggaccatcctccaaggctaaatactcctgactgaccgatagtgaaccagtaccgtgagggaaaggcgaaaagaaccccggcgaggggagtgaaacagaacctgaaaccgtgtacgtacaagcagtgggagccttctttatgggggtgactgcgtaccttttgtataatgggtcagcgacttatattctgtagcaaggttaaccgtataggggagccgcagggaaaccgagtcttaactgggcgttaagttgcagggtatagacccgaaacccggtgatctagccatgggcaggttgaaggttgggtaacactaactggaggaccgaaccgactaatgttgaaaaattagcggatgacctgtggctgggggtgaaaggccaatcaaaccgggagatagctggttctccccgaaagctatttaggtagcgcctcgtgaactcatcttcgggggtagagcactgtttcggctagggggccatcccggcttaccaacccgatgcaaactgcgaataccgaagaatgttatcacgggagacacacggcgggtgctaacgtccgtcgtgaagagggaaacaacccagaccgccagctaaggtcccaaagtcatggttaagtgggaaacgatgtgggaaggcacagacagccaggatgttggcttagaagcagccatcatttaaagaaagcgtaatagctcactggtcgagtcggcctgcgcggaagatgtaacggggctaaaccatgcaccgaagctgcggcagcgacgcttatgcgttgttgggtaggggagcgtttctgtaagccgtcgaaggtgtgctgtgaggcatgctggaggtatcagaagtgcgaatgctgacataagtaacgataaagcgggtgaaaagcccgctcgccggaagaccaagggttcctgttcaacgttaatcggagcagggtgagtcgacccctaaggcgaggccgaaaggcgtagtcgatgggaaacaggttaatattcctgtactcggtgttactgcgaaggggggacggagaaggctatatcagccgggcgacggttgtcccggtttaagcgtgtaggcggagtgtccaggtaaatccggacgcttgttaacgctgaggcgtgacgacgaggcactacggtgctgaagtgataaatgcccagcttccaggaaaagcctctaagcatcaggtaacacagaatcgtaccccaaaccgacacaggtggtcaggtagagaataccaaggcgcttgagagaactcgggtgaaggaactaggcaaaatggtgccgtaacttcgggagaaggcacgctggcgcgtaggtggagggactagctccccgagccgaagccagtcgaagataccagctggctgcaactgtttattaaaaacacagcactgtgcaaacacgaaagtggacgtatacggtgtgacgcctgcccggtgccggaaggttaattgatggggttatccgcaaggagaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactacagcttgacactgaacattgagccttgatgtgtaggataggtgggaggctttgaagcgcggacgccagtctgcgtggagccaaccttgaaataccaccctttaatgtttgatgttctaacgtaggcccgtgatccgggctgcggacagtgtctggtgggtagtttgactggggcggtctcctcctaaagagtaacggaggagcacgaaggtcagctaatcacggtcggacatcgtgaggttagtgcaatggcataagctggcttgactgcgagagtgacggctcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgctggagaattgaggggggttgctcctagtacgagaggaccggagtgaacgcaccactggtgttcgggttgtcatgccaatggcattgcccggtagctaagtgcggaaaagataagtgctgaaagcatctaagcacgaaacttgccccgagatgagttctccctgactccttgagagtcctgaagggacgttgaagactacgacgttgataggccgggtgtgtaagcgcagcgatgcgttgagctaaccggtactaatgacccgtgaggcttaaccttacaacgccagaggcgtttttgcagagacaggttttcagcttgttaaccggatacagttgtgtcctgcggactgaagtccgaaggattttgcgctgaggcaaggcggcaaccgagcgatacgaaggagcatactgaagtatgtgacggagtagcgcgagggcgaccaacgcagcatcagcacaaaagacacaggacagagcacaaagaatttgcctggcggctttagcgcggtggtcccacctgaccccatgccgaactcagaagtgaaacgccgtagcgccgatggtagtgtggggtctccccatgcgagagtagggaactgccaggcatcaaattcgttccttttcccctgacaaggaaaataacaggaacagacggccatcagcccgttgctgacagctgtgaaagaatcggtggagcggtagttcagttggttagaatacctgcctgtcacgcagggggtcgcgggttcgagccccgtccgttccgccacttaattggaaagccctgacttaacggtcagggctttttccattgcagcaaattcaacacggaaaaatacaccgcgctgattctcttcgatctcccggatcattttaacgatcgctaattctttgaatctgaagcgataatcccgcgagcgatcccacccctcccaattgtgtgcgggcagaccccgatcaggcctgcccctgtagacttcaggtacgccacggttggtcagctgtccactcactcagaaaatcgataaaagcgcgcacacgctggcttacgccaatatcactatagtaaacagcatggaagggcatctcgaccggcagacgctgatcggccaacacttccaccagttttccctcagcaacttcacgatcgatcatatagtccgacaggcaggcaataccattaccggtaagacagagctgcttaatcgtctctccgctgttagaggaaatagtccagctaatatcatagagtttcgccgctttcacgggagacgggccagcgattgagtcgtggggaatcatcaaagccgagacaatggtgattatccagctcagccaccgtttgcggtgtcccatgctcacggagataggcgggtgaagcaaccatcttgcgaaagctcctgaacagcagccgggcgcgcagcgttgagtcggtgagattgccggcgcgaatggcgatatccactttccgctcaatcagattgataaaactctctgaggagatcaaagaaagagtcacgtcaggatagcgcagacgaaagggtttaatcatcggcatcagcaaatgcagaatgaccggcgtcgcggcatcaacgcgcagtagtcctttaggcgcctgtaaactctcgatcaaatcgctttctgccgtggtcatctcctgcaaaaaacgttgaacatggcgaaaatagcgttcgccctcctgagtaagcgccagctgccgtgttgtgcgggtcagcagggcaatacccagcttgctctccagctttttaactgtcctgctgacggcagagttagccatcttcagctgttcagcagcgcgactgaaacttccattttctactacgctgacaaacacttttagttcatcagaagatgccttcattcttcctccctgcagtcacatggccattaagccagtttatgactgataatgctgttataaccagtacaggagccgttaacgatgacatcggggatgtcaccgcctgatctgcctcgttttgcttagcgaacgtaaaagggctgctttattctggaaaaggtgatgaattctgacattcacctgcatccattgaaaccccggtctaaaatccctataacagacaggtattaactgtattttgaatcatcagccaggcgggaaagtgcgcaaaaaaacttatgcaatgcgatatgtagcaggacaaccagtggaacagatctttccacctggcgcgatgctccatctcggtcaggcactgccacccggcgcacccttgcccgcgcacccaaacctcaaagttctggtgtggaacatcttcaagcagcaacgcgcagactggatgtcggtactggaaggatttggtaaagatgcgcacctggtattactgcaggaagcgcagaccacaccagaactggtggagtttgccaccagtaattatcttgctgccgatcaggtacctgcctttgtgctgcctcagcatccctctggggtgatgacgctcgcctctgcgcacccggtctattgctgcccgttgcgtgagcgtgagcctctgctgaggctgtcaaaatcggcactggtcacggcgtatccgctgcccacgggggaaatgctgatggtcgtgaacatccatgcggtaaatttcagcctgggcgtcgacgtctacagtaaacagctggggccaatcggggagcagatcatgcatcaccaggggccggtgattatggccggggatttcaatgcctggagccgtcagcgtatcaatgcactctaccgttttgcacagcgaatgaagctggaagaggtcatgttcactgccgatcaccgccgtaaagcctttggtcgcccgctggatttcgtcttctatcgcgatctcagggtgagtgaggcatccgtactggtgacgcgcgcgtccgaccataaccccttactggtggagttcagttcaggaagctagtccggtgcattaagcgagcctgctgaaggggagggaagtccggcagatgagtaaacggtggcggatgaataaaagaaaaaggctgacaaatgtcagccttttcaacgtatcaggtatcaggtatcaggtgttgcgttattattcacaaacagcgttaagttatcgccgggttgaatatctttcgcactgtccagcacactgttccagcgcatcacgtctttgatattaacgccgtgatgacgggcaatactgtcaagagaatcacccttacgaacacgataggtgatgctgttgccgttatcagccagtcgggtgccattcgaaccaatggtcagagtctgacccggtcggatatcagcaccgcgcaggttgttatcctgcttcagtgtcgagacgctaacgccaagttttgaggcgataccagagagcgtatcaccacgtcgcactttgtacccgccactcgcactggctttcgcaagctgagtaggctgtaccgctgcgatgtcaccggaagccagtgagttacgcagtttcgcgacgtttcgacttcggcaccataatatagtgtgggccgtttggcgctgttgcaccgcctttataaccggtattgaagctcttcagtttcgtgagcgacatacccgccatttcggcagcctgcgtcagctgtatctgctgacccacttccactcgcgccagagcacgactttcattaggtgtcggcagtttgataccgtaacgcttgttatttttgagcagttcactcagagctaacattttaggcacatacacggtcgtttcgcgtggcagcgataaatgccagaagtcagtcggcttaccgcgcgccttgttctgctttatcgctttgagtacacgtccttcaccactgttgtacgctgcgatggttaataaccagtcgccgtcaaacatggtgttaagacgctgcatcatatccagcgcaactttcgtggatgcgaccacatcgcgtcgcccatcgtaatactggttctgtttcaaaccatagtttcgacctgttgcagcaacaatctgccagataccagcggcattggcggatgaagttgcccgggggtcaaaagcgctctccactatgggtagcagtaccagttccatcggcattttacgtttctgtatctgctcgactatccagtacatgtacggctctgcccgtaatgttacatcgtggagatagctcttattttttaaaaatttacttttttgttcgcggattgccgggttttccggaatccccatcttcaactcgtcactaatgaaactccagagatctgcgtctgctgcgaggccagttccatcttcctgccatcgcggcgacaaaaactcgtctccgtactttccattttcaccttgaccagctgaagacagactctgtgcatgctgtaccgggatattggcatcgtttcctggacgcctgacatcctaccagcaagactgaggcgagtaagatcgctttagccttcatgtgtgtgtcaatagttcgcttaaaagacgagcaactatacgtgacgacttttcacaacacaacccgaaaaatcaaaaagcgtctttcttctcgcgtagaacggcaaatgaacgccatacgggttcatcagtaacgttaacgtttaatgccctttgtaaatcaacgtcttgcgtgcgaagaaataaatttattgtccgttcgtgcgccagttttgtgggcaaactaatgccattttcagcgcgtaagtccttaattttctgatattcggccgttatttgtgggtcgtggggcagaatagccgcagcaaacttcagattggataaagtatattcatgtgcgcagcagactaatgtttcacctggaagctggttaagcttttgaaaggaatcatacatctgctctgccgtgccctcaaaaaggcgtccgcagccgcccgaaaagagtgtgtcaccacagaaaagataaggtgagctgtaatatgagatatgtcctaaagtgtgaccaggggtgtggatcacctcaaacgtcaggcccagtaccgtgaccttatcgccttcgctgactatcgtttctggcccctttagccgcagtttcctggggaccatagacctcaaggtgagggaaatgctcgcacagtgttttcactccgcccgtgtggtcgttatggtggtgagtcagcagaatagcgaccggctgccagccgttggaggccattttttctaacaccggttgggcttcgccgggatcgacaatcaggcatttaccgtcatcatcagtcagcgtccagatgtagttgtcctgcaacgcaggaatactggtaagattcatcatcacctctcgcaggtcgtaggaaaaggaagagcgtaaagcatgaagcccgctaaatcacgccagattctgaacgcaccgctgtcatggcgcgatatgccgtggggagattatttccgcgacgcgctaacgcagcagcttcagccttaccttggaaagctttatggctttcatatgcttaagcttggcaacctcagcgcagaaatcaacaccgaaaactgtgctatttcacatcaggtcaatgttggcagggaaggtgagctgttacaggtgctggctgacccgatgcaactgccgtttgagtcgaagtcgatcgatgcctgtttgctggcccatacgctcgcctggagccaggatcctcaccgggtgttacgtgaagtagatagggtgttaattgatgatggctggatgattatcagcggcttcaatccattcagcctgctcggcgtgagtaagatggtgccgggcctgaaccgcaaagccccctggagcggacggatgttcagccaggtgcggttagtcgactggctgggactgttgaattatgaggtggtctatcgcacccgctttcaggtgctgccgtggcatcggcagggcggaaaactgatcagcgcccacttaccggcgctgggctgtctgaatattgtggtggcacgtaaacgcaccttcccgctgctgccgacccgggctaagaagagtatgagcaccagcaagatccgccagacggtcaatgccacacgccagtttccggcaggcagaggatcaggattcggttttataaccgatatcctcaaaagcgggattttcagctgcgctgcgggccagcacgtcgcagcgctcattttccggatgtccggcatggcctttaacccactcccactgaatcttatgggtgctgagtgctaagtcgagacgctgccagagatcgacattcttcaccggctttttgtcggcggttttccagccacgctttttccagttatggatccagctggtaattccctgacgcacatactgactgtcggtactgagcaccacatcgcacggctgggtcagcgcttccagtgagacaatcgccgccatcagctccatccggttattggtggtaaggtgatagcccgcgctgaaggttttctcatgctgaccgtagcgtaaaatcgccccataaccgccgggaccgggatttccaagacaggatccatcggtgaatatttctacctgtttgcgcatctctggtagacttcctctcaaaaacgctaagtctgacataaaacgggtcttatgagcactgcaaataaccgccagatcgttctcgatactgaaaccaccggcatgaacatgatcggggtacattatgaggggcaccgcatcattgagattggtgcggtagaggtgattaaccgtcgcctgaccggtaacaatttccatatgtatctcaagcccgatcggctggtcgatcccgaagcctttggtgtacacggcattgccgatgagttcctggccgacaagcctgcattcagcgagattgccgatgagtttctcgactacattcgcggtgctgaattagtgatccataatgccccgtttgatatcggctttatggactacgagtttgcaaagctgaaccgcggcattgagaaaaccgaaaccttctgcaaaatcaccgacagtctggcgctggcgcgccgtatgtttcccggcaagcgcaacagccttgatgcgctttgctcgcgttacgaaatagacaacagcaaacgaaccctgcacggcgcactgctcgatgccgagattctggctgaagtcttcctgacgatgaccggcggacagacgtcactctcctttttatcggaaagtgaaagcgcccgacaggcgcagggagagagcatccagcgcatcgtgcgtcccacctctgcattgcgcgtggtcacggccagcgatgaagaagtggttgcccatgagtcacgtctggatctggtgatgaaaaagggtggcagctgcctgtggcgcggctgaattacgcatttttgtggataaaatcaacggcaagctgaaaaaaacagcaaacgatttgttcgcctggaaaaagcgttgacgtcgcaacaggctgccattactatgcgcctcgttcccgacggggaacaaagcgcggagcggtagttcagttggttagaatacctgcctgtcacgcagggggtcgcgggttcgagccccgtccgttccgccaatctctttaaaaaagccgattcagaaatgaatcggctttttgctgtctgctattcagcggcggcctggttcttctgcggcatcacctcgccttgccagcgggcaccatcctccgcctcacgatcttcacgggcaataaagcgatagcagcctgccgccagaccggcaccaataaaccagctgaagttcgccacctgatgcagggaagggataaagctaatcaccaggcaaatcgccaccgatggcagcagcgcgccaatcgctttagggttaaagccaccgcgataccagtaacggcctgctggcgtatcgttaaacagatcgtcgaccgagatacgtccacgtttaatcagatagaaatcggtcagcaaaatcccgaacagcggcccgataaacgatcccagcacatccagcgtgtagtgaatcagctctggagactggaacagattccacggcgttaacagcaccgaccccaccgcagcgatcatcccgccggtacggaaactgattttctgcggtgaacagttagagaagtcaaaagcgggtgagacgaagtttcgccacgatattgataccgatggtggcggtaatcatggtcagcaatccaatcgcgaccgccagatcgttgccgaccatgcttacggtttcgatgggatcggtaatcattttgccaaacagcgactgggtgcccgacacaatcactacggtcaccaccgagaacagcagaaagttaaacggcagtccccagcggttgccgcgacggatctctgacatgcttttgccgtagcgtgagaagtcaccgaagttcagcagcggcccggagaagtaagagaccaccagcgccgtcgccgtaatcatctgccacgtctgctcgcctgcggtcagcgatttgctggcgagagtaaacgagatcccatcgaagccggtcttgtatacaatccagcccgccagcgccaccatcaccacatagaccgccggtccggcgacatcaataaaccgtttgatggcgttcatgccatgccagaacaccatcgcctgcagtaaccacataatgccgaagcagcaccagcccagcagcgacagaccaagccagtgcggcacggtcatcgacgtcagcgacggcgcgaacttcagcagcaccagcatcagcgcattcgccgccagataggtctggatgccataccaggcgaacgcgatcaggccgcgtatcaccgccgggatattggcaccaaacaccccaaacgcctgacggcagatcaccgcataggggacgcccgccatctggctcggtttcgccaccagattcgcacagatctgcacgatgcagatccccgccagcaggcagagcagcacctgccagctggctaatcccagcgtgaagaagctggcggccaccacatagccgcccatgctgtgcacatccgacatccagaaagaaaaaatgttgtaccacgaccagttctgatcgcgagtcggtgccaggtcgtcgttacagagtcgtgggctgtaacgggcgttggcttcagaggccgtgctggccaccgttgattgatttggcatgaaacctgctcctctacccgagagtggaatgaataatctggtaaagcggtattgcaggatccaggccagatctcttttcttgtatacaatatttatttttcacgtatacgatatgtggcgtacagcaagcgaccggagcgggtaatgacgagtaaaacaggacagcgagacgccaccaggctgcaggataaagatgaagggatttaccaggcgttgatgaacgccattgttgagcatcagctgccgccgggcagtaaactgccggaagaggccctttccggggtcttcggtgtgagccgcaccggcatccgcaaagtgctgcaacgcctcgcggcggtgcaaatggtcactctgacgcccaaacgtggtgcgcaggtctccacacccggcgttgaagaggcgcgggatatcttctcaacccgcagtttaatggagtgcgctaatctgccagcggtcctggcccatctgcagcccccgcatctggtggcgctggagcagctcatcgcgcaggagaaccaggcgcacgccgatcatgatggcccggcagccatccggctgtcagcggcctttcatattcagttgcaggcgatctccgggaatcaggtgctcaccggcatggtgaccagtctgacgcagcgatcatcgctggtgatcgccgcctatggcgcaccctggcagcgtggctgccgctgtgacgatcatgcgaatctgcttcagttattgcgcgcgcgtgcgctgcagccgctgacgcaggcgctacagcatcacttcgagcacatcgtctccagcctgcactttgagcgcagcggggaaacgctgcccgacttttcccgactgtttgccgcaggctctggagcggcctcatgagcctgattcaggttattaaccctaataccagcctggcgatgaccgaaactatcggtcaggccgcgcgtgcggtcgccgcaccgggcaccgaaattctggctgtttcgccgtcgcagggcgtgccttccattgaagggcacttcgatgaggcgatcgccgccatcggcgtactggagcagattaaactgggcagagcgcagggcgttagcggccacgtcattgcctgctttggcgatccgggtttgctggcggcacgcgagctggccagcggaccggtgatcggcattgcggaagcggcgatgcataccgccacgctgctggcgacgcgtttctccattgtcaccacgctgccgcgcaccctggtgattgcgcgtcatctgctgcagcagtatggctttacccatcactgtgccgcgctgcatgccatcgatctgccggtactggcgctggaagatggcagcggcctggcgcaggaaaaagtgcggcagcgctgcattcaggcgaagcgggaagatggcagcggggcgattgtgctgggctgtggcggaatggcgacgctggccggggagctgacccgggagctcggcctgccggtgatcgatggcgtcagcgcggcggtgaagatggtggagtcgctggtggcgcttggttttggcaccagcaaacatggtgatctggcctggcctttgcagaaacctctctcaggtgcgtttcagcatctaaactaacggaactttcccgaatcaaaacaggtggagtgatgactgacgctgcagagaagaaagagtacagctttaataaaaactatccgcgcgatttaatcggttatggcgctcatccgccgcacgccgcctggcccaacaacgcccgtgtggcggtgcagtttgttctgaactacgaagagggcgcagaaaacagcgtgctgcacggcgacaccggctcagagcagttcctctccgacatcatcggggcagcgagctatcccgatcgccacatgtcgatggagtcgctgtatgagtacggctcacgcgccggtttctggcgtatccacaatgaattccagaaacgcggtctgccgttaacggtcttcggcgtggcgatggcgctggcgcgtcatccggaagtcgtcgaggcgattaaacaggctgactacgatgtggtcagtcacggctggcgctggatccactatcagggcatggatgcaaaaaccgaacgccagcatatgcagcaggcggtcgatgtgctggttgatctgtttggtaaagcgccgaccggctggtacaccggccgcgacagcccgaatacccgtcggctggtggtggagcagggcggttttagctatgacagtgactactacggcgacgatctgcctttctggacccaggtcacctgtcaggatggaacggttaaaccgcacctgattatcccctataccctggagtgcaatgacatgcgctttgcctcgccgcagggatttaataccgccgaacagttctttacctatctgcgcgacagcttcgatgtgctgtatgaagagggcgaaaccgcaccgaagatgatgtcgatcggtatgcattgccgcctgctgggccgtcctggtaaattccgcgcgctgcagaattttctcgatcacatccagcagcatgaggatgtctggatctgcacccgtcagcagatcgctgaccactggatcaacacgcacccggcaccttaagccggttccggcgctcgccccgcgttgatcgggcgaagcgccggacgatgtcagctcatcaggctgacctgcgccgccacgatgcaccagccgtggggcatgcgtacccaggtctgctgctgacggccaattttatcgctgccggtgcgggtaaattcggtgctgcagaccgcataatcctcgccaaaggtggtgatcacggtgtttcgcagcgtccggttcagcccggctgcaggacgcgcggcgcggaaggcccgaatctcatcaatgccatacagattctcacccgcgccgaggcgcacggttcgcgggtcgtgccagaaacaacgcatccagttcggccacgtcattgctgaccagcgcctgctcgtagcggtaaaactgcgccgtcacctcggtgacgacctgcggtaaattaatctctctgctcatcaggctccagccatattgatttgcggtatcgtaatgccgcgttgttccagtgcccaggcggcacgtaacaccgcctcttcattaaatggacgtgcgataagctgtaatccaatcggcagaccgcttcgggtcgccagcggcacggtacagaccggcaatcccaggaaggagatcggctgcgtcagcatacccatgctcgccttagcgggcagcgattccccctgaatcgacagggtctgctgaccgatggtgatcgcgctgcagggtgtcgccggcgctatcagcacatcaaaccgatcaaaaagcggcaacacctgctgctggaaatggcggcggaaacgctgcgcctgcacgtaccaggcacctggtatcatggcaccggccagcagacgctcgcgtgaattgggttcaaactgctcaggcgtctggcgcagggcgggcagatagtgattgccgccttctgccgcggtcatgataaatgccgccgagcgtgccagctcagcgtccggcatcagcacctcttcctgtgcatcaagtgctgccgcgaccaccgcgacggcagcgcgggcatcctcatcgcaccagcgggcaaaaaagccacccagtacgccgcagcgcaagccttcgctgccctgtgacagccctggtagcgtcgcggccagcgggcgatcggcctgaaacgcatcggtgtggtctgcgccctgcaacagatcatataccagcgccaggtcttcaacccgccgcgccagaggaccgatgtgatcgaggctggcgacaaacggatggctgccgctgcgtgacaaccggccaaaggtcggcttaagaccaaaaataccgcacagcgacgcgggcacccgaatcgagccgttggtgtcggtgcccagtgaaaagtggaccagaccggcggccacggcagccgccgaaccgcctgacgagccgccagccacgcggctgagatcgcgcggattgtgcgtcgcgccgtagtggctgttttcggtggtaaaaccatacgcgtaggcatccatgttcagcatgccagacagcagcgcaccagagcgacgcagtttatcgacagcaaacgcatctgcacgtgccgccggccggtcgctgaacaggctggcaccggccagggtagtgtgacccgccacatcaaacaggttttttaccgcatacgggatgcccgccagcggtggcagggtttcgccgcgctgccgctgcgcatcaacatccgccgcttcttttaacatgcggggcccggtcacttccgtccaggcattcagcgccggattatgctgctcaaccgcctgcagcgtgcgctttgccacttccagcgcactgatttcaccctgctgaatcgcccgctgcagggtctgaatcgaaacgtcacctaatctcatgcctggtatactcctgccacttcaagccggtcatccagcggaaacgtcatcagcggcgcggtcatctccgcgatacgcgacagctggatcagcagttcagcgcggcgggcgtcatccagttccagttgcagtatctgctccatatggccgatgtagctggcccagtcgtgttgattcatgattcgctcctgttaaaaaccggcggcgctgccgttactgcgtggatcgcttgcgccctcaaacatgccgttgctgtggcgcacaatggcgcccgcatggcccacggattcgctgaagtccggcagcagctccacctcatgtccccacagacgcagcatcaataccgtttcgtcgtcaaaacggccttccagtttcagcgagtctgatgattgcccccaggtccggcccagcagccagcgcggcgcactgactgcctgttgtaacggcaagccctgaatcacatggcgggtaaaaatcgccgcctgagtctgcggctgtccatccccacccatcgcgccatacaccagcgtccggccatctttcagccgtgcggcggcgggattcagggtatgaaacggttgcttaccgggtgccagggccagcagatggtcaggatcgaggctgaaagcggcgccgcggttctgccaggtgatacccgtgccgggcagcaccacaccactgccaaattcgtgataaatgctctgaataaaggagacggccaggccgctgctgtccatcacgcccatccagaccgtatcgcccggcccgcgtccgtttccccatgccgccgcctctccatcggtgatctggctggcgagtgtggcaaggtgatcgctgtccagcagcgcctgcaaatcttccgtgacgtgacgcggatcggtgatgtgtttgtcgcgcagtgcaaacgcttttttggtggcttccacgatacggtgcaccgtctgcgcatcgtcagcctccgccatctccagccgatcggtgatgcccaggatcgccagcgacaccatgccctgcgttggcggggtgatattccagatgtcaccttcgctgtgggagagatgcagcggcgtcgtgcggcgggcgcgatgctgctgcagatcggccagcgtcaccggcatgcccagcgtggccatctcatcggccatatggtgagccagcgtgccgcgataaaagctgtcgagcccctcttcagtaagctggctgagggtgtttgccagggcgggctgggtaaaacggctgcctggctgcggcacgttgccgtcaggcataaaggtggcgctgaagccgggctgatgctgcaattcactgcggaacgtcgcggtggcggcgctctgtgaggtggtcaccggaataccgtcggcggcgtagcgaatcgcatcgcgcagcagacgtgccagcggcagcggcggggtgcccatctcagccgagagattcagtgcctcctgccagccgctgaccgtaccggccacggtcagcgccgctttcggcccgcgatgcggaatcttagggtgatcggcgtagaaatcgtgatgagccagcgaaccggctgcgccgctggcgtcgatagcgacaggatcgccgccgggcggcagaatcagccagaaaccatcaccgcccagtccattcatatgcgggtagactacggcgatggtcgcggcagcggctaccatcgcttcaatggcattaccgccatcacgcagtaccgcgagcgcgctttcactcgccagatggtgtggcgtcaccgccatcccctgcggggccatgttgctttgaatcatctttttctcgttatccgggtgacagaaccgataacaaagcaagagctgttccagttttcaccctgagctgacaatgcgccggttaacctggcgcaaattgtgctagcttctgctgaaacaaaagttacaggacgggttatgaaacagcttgatgaacgactcaggagtcactatccccagctctctccgcaggagcagcgcattgccgacttcgtgtttgaccacttcgatgacctgatcagctacaacagtgccgagctggcgcggctaagtggcgtgtctaaagccacggtcagccggctgtttaagcgcctgggctatgaaaaatacaaggatatgcgtgatgagttacgcatcctgcgccagagcggcatgccgctgactgataatcgtgatgcggtgcagggcaatacgctgctggcgcgacactacaagcaggagatggctaacctgacgcagtgggtgaacagtctggatgcccggcactttaatgaggttatccagcagctggcacaggcaaaacgcgtctttatcatcggcatgcgcaacgcctatccggtggcactgcatctgcgacagcagctggtgcaggcgcgtttcgcaggtacatatcctgccgcagccgggccagacgctggctgaggagctggtggatattacgccggaggatatggtggtcgtgatggccttccgtcgtcgtccccgcatcattcgcccgctgatgcagcagttgcaggctgccggtatcccgctgctggcgctgtgtgagccgcaggcgcagacggtgattgcgctggcgcgctggcagctctgtacgccgctggacagcgtttccgccttcgacagttatggctccgccatgagtctggttaacctgattgccaatgcactgctgcatgaaatgctggcacagggacgccagcgcattcatcagatcgccgacctttaccagcagtttgatgagctggagcaccgctaacaggcaccgttttggtgctttgccccatttcagaacagaccttcccccggcgtagtcgtccagattacgccagatttcagctgaatgctttgccacttaaccctttttctgtagccgtccgggttggcacattagttgcagattgcatgctaaagaatcttttgtttcacgttaatctcaccggggtgcataatgaaaaaagttttgatggcggttgcgacagcggcattactgatggcacaagcgggaagcgcgctggccgatcaactgcaggacatccagaaacgcggcgtcattcgcatcgccgtgccgcaggatttcccgccgtttggctcggttggcaccgatctgcagccgcaggggtatgacatcgacacggccagatacctggcaaagcagatgaaacttaagttgcagctggttccggtcagcagtgccaaccgcgtgccttatctgcaaaccgacaaggtcgacctggtgatctccagcatgggtaaaaatgccgagcgggaaaaagtgatcgacttcacccgcgcctatgcgccgttcttcctgggcgtattcgggccgaaaggcgatgaaatcaaagcggcgtctgccctgagcggcaaatcgatcggcgtaacacgcggtgcggtagaggacatggtgctcagtgacgttgcgccgaaagatgcacaggtgaaacgctacgaagataacaacactaccttgtctgcgtatctctccggtcaggtgcagtatgtggcgaccggcaacctggtggtcgccgccattgcccgtcagaatccggctaaagcgccggtggcgcagtttatgctgaaagattctccctgctatatcggcctgaagaaagatcagcccgcactgaaagcgaaagtaaatgcgctgattgagcagggcatcaaagatggcaccctgaataaactgtcagaagagtggctgaaagcgccgctgcccgccaacctcggcgcctgaggaaagattcatgaccgggcaacttaactttcccgccctgtggccctactggccggagctgctctccggtctttgggtcaccattcagctgacggtgctggcgactaccggtggtgtggcgctgggcattgcgggcgcggcgctgcgcagtggcagacccagctggatgagccgcctgtggggcatctatgtcgagctgatccgcaacacgccgtttgtggtgcaactgttctttatcgttttcggtctgcctgcgctgggactgaaactcactgctggcgaggcggcgctgctggcgatgctgatcaacctcggggcgtatagcaccgagattattcgtgccggaatacaggtgacacccaaagggcagtgggaagcgggacgagtgctgggattaacccgcagccagacgtttctgcgggtggtcttgccgcccgcgctgcagcgcatttatccggcactggtaagccagtgcatcatcgtgatgctgggtttcgtcggtggtgtcgcaggtctcctacgaggagctgaccttcgccgccaacctgatccagtcgcgcaccttcttaagttttgaggtctatctggtgaccacgctgatctacctggcgttgtcgattgcgatgcgccatctgctgctggcgattggccgtaaatggtttggagtgcagccatcatgatgacgacctttaccgactgggacatcctgcgcaacctgctgctggcggcacgctggaccctgttgctgtcgctggtggcctttgtcggcggcacgctggtgacgctgccgctgctgtttatgcgcctgctgcaacgcaaatggttaacgcggctggtacgcggttacaccgcgctgtttcagggcacgccgctgctgatgcagctgttcctggcgtttttcggcgtcggcctgttcggcattgatgttgcaccctggacggcagcctcgctggcgctgaccttctacaccagcgcctttctggtcgatatctggtacggcagcatccgcgccctgccaaaaggccagtgggaagcgtcgcgctgtctcggcctgacctttggtcagacgctgtggcgggtcattgcgccgcaggcgatccgcatcggtattgccccgacggtggggtttgctgtccaggtgatcaagggcaccgcgctggcgtcaattatcggttttatcgagctgaccaaagcgggcaccattctgaacaacgtgacctatcagccgtttaaagtctttgggctggtggcgctgggctacttcctgatgtgttatccgctgtctcgctacagccagtatctggagaaaaaattcaatgccgctcatcaccattaatcaggtgcaaaaatattacggcgacaaccatgtgttgaaaggcgtggatctggatatcgacatgggcgaggtgatctcaatcatcggtcgcagcggatcgggcaaaagcacgctgctgcgctgcatgaacgggctggaaggctatcaggagggcagcatcaagctcggcggtatgacgattaccgatcgcgactcgcaggcgcgtgaaatcagccgctcggtcgggatggtgtttcagagcttcaatctgttcccgcacatgacggcactggagaacgtgatgctggcgccgcgccgggtgctgaaaaaaagcgaggccgagtgccgggcgctggcggcgcagatgctggagaaggtcgggctgggcgagcgtctcaactactatcctgccagcctctccggcggtcagcagcagcgcgtggcgatcgcccgtgcactggcgatgacgccgaaagttttactctgtgatgagatcacctccgcgctcgatcccgagctggtgggcgaagtgctcaaagttctggagcagctggcgtcagaagggatgacgctgatcctcgtcacgcatgaaatgagcttcgcccgcgacgtgggcgatcgtgtggtctttatgcatcaggggcgcgtatgggagcagggcgacagtaagacgctgttcgctcagccgcagtcaccggagctgaagcagtttatctcttcggttcgcctctgattctgaaaaaggaaattacgatggatatcaatcactacccgcaacttaacccgccacagcgtctgctaatggggccaggaccgatcaacgccgatccacgcgtgctgcgcgctatgtcgagtcagctgctggggcagtacgatcccgcgatgactcactacatgaatgaagtgatggcgctctatcgcggcgtgtttcgcacagagaaccgctggacgctgctgattgacggcacctcccgcgccggtatcgaatcgattctgctgtcatcgatccggcctggcgacaaagtgctggtaccggtgtttggccgctttggtcatctgctgtgcgaaattgcccgccgctgtcgtgcggaagtgcacaccattgaagtgccgtggggcgaagtctttactcccgaccagatcgaagatgcgatcaaaaaagtgcggccgcgcctgctgctgaccgtgcagggcgacacctcaaccaccatgctgcagccgcttgagcagctgggtgcgatctgcaaacagtatggcgtactgttctacaccgatgccaccgcgtcgctggcgggtaacgcgctggaaacggacgcctggggacttgatgccgtatccgcggggatgcagaaatgcctgggcggtccatcgggtacctcgccgatcacgctgagcgcagagatggaggcggtgatccgcaaacgcaaatgcgtagagcaggggatccgcaccgaggcgcatcaggatggcgaagaggagatgatctactccaactattttgatctcggcatgatcatggattactgggggccggagcggctcaaccaccataccgaagcgaccagtgcgctgtttggcgcgcgcgagtgcgcccggctgatcctgcaggaggggctggacaacggcatcgcccgccacaagctgcacggtgaagcattgctgaaaggcattcaggggatggagctggagaccttcggcgacctgaaacacaaaatgaacaacgtgctgggcgtgatgatcccgtctggcgtaaacggcgatcaggtgcgcaagctgatgctggaagatttcggcattgagattggcacctcgtttggcccgctgcatggcaaggtgtggcgcatcggcaccatgggctacaacgcgcgtaaagattgcgtgatgcagactctctccgcgctggaaacggtgctgacctatgtcggctatcgcacgccgcagggtgccgcggcgcaggccgcctgggatcactacgggagccacgcatgatgatgagcgccagcgaagcccaggccgctgcacagcgcgttatggcgcgctgcgatgcgctggcggcgatcagcgaaacggccgaggggctgacccgcgtctacctctcacccgaacatctgcgcgccaacgcctgtgtcggtgaatggatgcaggcggcggggatgcaggtgtggcaggatgaagtcggcaatatctgtgggcgctacgaggcggcagaagcgggtgcacccgcgttactgcttggctcgcatctcgacacggtgcgcaacgccggtcgctacgacggcatgctgggcgtgctcagcgcgattgaaaccgtgcagtggcttaacgaacatcagcgccgcttaccgctggcgattgaagtcattggctttggcgacgaagagggcacccgttttggcatcacgctgctcggcagtcgtggtattaccggcagctggccgcaaagctgggtgacgcatcctgacggcaacggcatcaccgtggcgcaggcgatggcggatgtcggtctcgacagcgacaggatcgcatctgcggcgcgacgggttgaggatatcgtcggttatcttgagctgcacatcgagcagggcccctgcctggagcaggaggatctggcgctgggcgtggttacagcgatcaacggtgcgcgccgcctcaactgccgtttcaccggagaagcgggccatgcgggcacggtgccgatgacccaccgcaaagatgcgctggctgccgctgccgagtggatggtgtttatcgagcagaccacccgtgagcaggatccgcaactggtggcaaccgtcggtacgattaactgcgcgccgggggctgtcaatgtaatccctggcgaggtatcgctgtcgctggacgtgcgcggtccgctggataacccactggagacactgctctccagtctgttaacccaggcggaggcgattgcgctgcggcgtggactccgctttgagtcgaacgaatattatcgcatcggtgccaccgcctgtgactccgcgctgcaacaggcgctgagtcatgcggtggaaacggtgcaggggcgcagtctgtcactgccgagcggtgcggggcacgacgccatcgctatcgctgaacgctggccggtcagcatgctatttgtgcgtaaccatcgcggtatcagccaccatccggcagagtccgtggcggtggctgatgtggcgcccgcgctgcaggcttatttacaggcggtctcgctgattgctgaacggagctgaacatggaattagccgcatttaatcagctgtcggctgatgaggcgcaggcggccatccggcattgtgttgccattccgcactggcagcagtcgctggtggcagcccggccttttgacaccctggatgcgctacgggcaaccgccgatgcgctggcccgccagtggcagcagcctgagctggaggccgcactgtcggcgcatccccgcattggcgaacgcgcgaaacggcgcggataaagaagcggcactttcacgcggagagcagtctgcgatgcagcaggccgacagcgctttgcagcaggcgatgcagcaggggaatcaggcttatgaagcccgttttggccgggtgtttctgattcgcgctaaagggcgcagcggcgagcagatgctggcagagttgcagcgtcggttgcagaatagcgatcctgccgagcagcaggaggtgctggatcagctgcgtgaaattaccctgttacgcctgaaggagacgattcaatgagtactgttaccacccatattctggacacggcgctgggcaaaccggccagcggtgtagcgatttcacttgagcagaacagcccggaagggtggtttccgatttcacagggtgaaaccgacagcgacgggcgtctgaaagatctcacgcccgagccgctgacgccgggccactaccgtttaacggcagaaatcggcgactattttgccgccgccggtcgggatgcactctacgtcagcgcgcagatcgattttatgattgccgaagcgggcagccattttcatctgccgtttctgatttcgccctggtcctggtcaacctatcgcggcagttaatgggcgggctgacttcccacccgccattcacagcgaaaagcgatccgcatcctgccaggccgggaagcgctcgcgataagcattcagtgcgtccagcgacagctctgcgtccagcctggcgcgctggtgcggctcagccgcgctgaggatctcgccctgcggtgaaataatctggctgtcgccgctgtattcatgctgattgccgtcattgccgacgcggttacagcctgctacataagcctgattctcaattgcccgcgccagcagcagtgcctgccagtgcagtgcacgcggtgcaggccagttggcgacatagagcgccagatcgtaatcgttgcggttgcgcgagaagaccgggaaacgcaggtcgtaacagatttgcggcaggatgcgccagccgcgccactcaaacacctgacgctgttcgccaggcagatagtggtgatgctcgtccgccatgcggaacaggtggcgcttgtcatactgatgcagcgtgccgtccggctccaccagcagaaagcggtttaccgcgccgtgttcggtctgaatcgccgcgctaccgccgaccagggcatcgttgcgacgggcatgctgatgcagccactccaccacctgcgcctgaggcagcgagcttttcgccgcttccattgcaaagccggtggtaaacatctctggcagtaaaatcagatcgcgcccggtgagtccatccagttgctcgtcaaaatggcgcaggttggcctcgccatccatccagctcagcgtctcctgcagtaacgtgatttttaaagctgacataagcgctccgcggcggcatctaatgtcgccggctgtttggcaaaacagaggcggatcagtttatgaggaaaggcatcggcgcagaacaccgacagaggaatcgcggcaacgcccacttcgcgggtcagccactggcagaaactgacatcatccagatcggagatggcgctgtaatcgaccagcaaaaagtaggtaccttcgcagggaagcaccttaaagcggctgctgcttagcgccgttgccagccgatcgcggcggtcgcgataaaacgccggcagctcaagatagtgctccggatgctcacgcagcatatcggcaatcgccagctgcgccggcgtattcaccgagaaggtcagatactgatgcaccttgcgcagtttccgcgctgatcgcggcaggggcaatgcagtagcccactttccagccggtcatatggaaggtcttaccaaacgacgacaccgcgatagcgcgctggcgcagttcgggatgtgccagcacgctggcgtggcctgcctgatcgaagcagatgtgctcatagacttcgtcgctcagtacatagaccggtcgcgcagcaatcgcctgccatagcgcggtgaaatcctgctgctgccagacggtggcggaaggattgtgcggcgtattcaggatcaccagccgggttttatcactcagcagcgcagcaaacgcctgccagtccacccggaaagcgggcggctgcagcgtaatgcgtttcatcacgccgcccgacaactctaccgcaggcgcatagctgtcgtagctgggatcaaagcagatcacctcatcgcccggccgcaccagcgcggtaatcgccgcatagagcgcttcggttgcgcccgccgtcaccgtaatctctgtttcgacatcaggacgatagtcatagagccgcgcggttttctctgcaatcgcctcacgtaacggcagcgcaccggtcatcggcgcatactggttcgcgccctggctgacgtgatacgccagccgctgctgcagatagtccgggccgctaaaatcaggaaagccctgagagagattgatagcgttatgctgctgcgccagcgcactcatctggctgaaaatggtggtgccgagcaaagggagtttactcccggggatcaggttgtgctgcgtcatgatgtcaggccttaagcgcgaagattgatgcggtgtcacccggtgtttgtgccactataaacaggatggtagtatttggcaatcaagacgcttagatggctaaatgcgtcatactccacacctcagcttcgttagcttcgtttgcttaccccggtcactgacgagtgtcagctcccagcgataagcgcttgccgccttgctgagatgcggatcatctggcaggacccggagagtatggttcagcagtcgggcacgtttgctaactgtttaagattttcaaactgttgtaattttatagccattaccgttatctgagccacccgagatcatatttcaccgcaaggaacttttatgtcgcagagtcttccattagatcaactggtcgccgcctgtcactggattggcgcgaaaggctgggcaccggccaccggcggaaatatgtcggtgcgccgcgatgaacatgtctgcctgctgagtgaatcgggcaaagataaaggcacgctgacgcgggatgactttatcgaggtcgatattgccaccagccagtcgctctctggccgtaagccgtcggcagaaaccggtctgcacacgatgatctatcgactctttcccgaagcgggcgcggtgctgcatacccacaccgtgaatgcgacggtgctgtcgcgggtggagcagggcgcggcgctgctgctgcacggctatgagatgcaaaaatcattgagcggccagcacacccatctggatacgctggccattcctgtattcgacaacagccaggacattgcggcgctggcgtcagaaattgaagattacgctgcccgctttccgctgcgttacggctttctgctgcgcggtcacggcttaacctgctggggccgggatgtcagcgaagcacgccgtcatctggaaggtctggaatttttatttgaatgtgaacgtcaacgtcgcctgctggagagagcatgattcgcgccattgttactgatatcgaaggcaccaccagcgatatccgttttgtacataacatcctgtttccctacgcccgccagcatctggcgagttttttgcgtgaaaatgcgcatcagcccgaggtcgccgcagcgctgcagtcggtacgtgaggaggctggtcagccgcagtctgatctggatgcggtgacagagattctgctggggtttatggaccaggatcgcaaatcaaccggcctgaaagcgctgcagggcatgatctggcgcgatggctatgttaacggcagttttaccggccatctctatcctgacgtcctgccagcactgagccgttggaaggcgcagggcattgaactgtatgtatattcctccggctcggttgcggcgcagaaattgttatttggctacagcgacgaaggtgatattactgacctcttcagcggctattttgatacgcacgtgggtgccaaacgcgaagtcgcagcctatcgcactatcgccgctgaaattggtcagccagcggagcagttgctgtttctctccgatattcatcaggagctggatgccgccgctgaggcgggctggcagacgctgcaactactgcgtggcgatgcggacggcgagagccgccatcgtcaggtgacagatttttcccagattaacccggagtcaatttaggatgagcgcactgactatttttaccgaccgcgaagccagccagccggtgtggcacagcaccgacgcggaagagattcgtgaacgcctgagcaccaaaggcgtccgttttgagcgctgggaagccgatcgcgatctgggtgaaaatccggatcccgaaacggtgatcaacgcctatcagcatgcgatcgatcggctggtggcagagaagggctatcagagctgggatgtgatcagcatgcgcgccgataatccgcagaaaaccgtgctgcgcgagaagttcctctctgaacatacacacggcgaagatgaggtgcgtttctttgttgagggtgccggactcttctgtctgcacctggatggcgagatcctgcagatcctctgcgaaaaaaacgatctgatctcggtaccagcgggaacaccacactggtttgatatgggatcgtcaccgcacttcacggctatccgtattttcgataatcaggaaggctgggtagcgaactttaccggcgataagattgcggatgcctatccgcgtctggcgtaaaccgcccgtcgttttcgcaaggcgtttgccgctcacggtaaacgccttgcagaccgttattgtggctggaaaatgccaccctgaacctggtcaggcgtgactaccccggtgtccagtacccagccgctgatcagggtggcgggcgtgacatcaaacgccgggttatagatcttcgccgcttccggcgcccactgcacgctgccaaaactgccggcaacgcccgtcacttcactggcggcgcgctgttcaataggaatcgctgcgccgtccggacagctgcgatccagcgtggtatgcggggccgccacgtaaaacggaatctgatgataatgggccagcaccgccaggctgtaggtgccgattttattcgccacatcgccgttggcggcaatgcggtcagcgcctacccatacggcatcgacctctccacgggccatcaggctggcggccatggaatcggtaatcagggtgtaaggaatcgccagctcacccagctcccaggcggttaaccggccgccctgtaacagcggacgggtttcatcaacccagacattcttaatcagcccctgctgatgggcgcgggcaatcacgccaagggcggtgcccacaccggcggtggcgagtccgccggtattacagtgggtcagcagctggctgccgggtttcacccgcgtacaacccgcgtcagcgatggcatcacacagctgcttatcttcctgcaccagtcgccaggcttcttctgccagcgcgggggcaaagtccggctgcgccagcgccagtttcatccggtccagattgttcatcagattgacagcggtagggcgggcggcgcgcagggtctccagtgcctgcgccagttcagcgcgcgtctgcccctgttctgccagcaacgccagcagcagcgaggcggaaaggccgagcagcggcgcaccgcgcacccgcagcgcatgaatatgttcaatcagctggggcacgctgtgcgcgggcagccagttcttttgctgcggcagtgcctgctgatccagaatccagagctgattgtcacgaacctgtaagctggtggtttgaagtgtctgcattgtgggtgaaatccatgttgcgttaatgatacctattgtgccaacatgctgaacggatgtatagacgtctgaacggcttattacacccaggtcatcccccttcgattgatgaggaacaggcaatgtcgcaataccgtacctttactgctgctgatgctgtggaatatgcccgacaatttggcggcgtggacaatcctgccgcgctgagcagcgcagaagagattggtgatggcaacctcaacctggtgtttaaaatttatgacgatcagggcaacagccgggtggtggtcaagcaggcgctgccctatgtgcgctgtgtgggtgagtcgtggccgctgacgctggatcgggcgcggctggaagcgcagaccctggtcgaacactacaaatattgtccgcagcacacggtgaagatcacccattacgatgcggagctggcggtgatggtaatggaagatctctccagtcatcgcatctggcgcggcgagctggtgaagggcgcttactacccggaagcggctcagcagttaggcgactatctggcacaaaccctgtttcatacctccgatttcatcctgcatccgcaccagaaaaaagcggaagtggcgcgttttattaatccggaaatgtgtgaaatcaccgaagatcttttctttaacgatccctataccgaccatgagcgcaatagctatcccgaagcgcttgaaccgctggtcgccagcctgcgtaatgacgatgcactgcgcattgcggtgggcggtctcaagcatcgtttctttgcccacgctgaagcgctgctgcatggtgatattcacagcggatcgattttcgttgctgatggcagcctgaaagcgattgatgcggaatttggttattttggccctatcggttttgatgtcggcaccgccatcggcaacctgctgattaactactgcggcgtgccgggtctgctgccaccgcgtgaggccgccgatgcacgcgagcagcgtctcagcgatgtgcacaccctctggaccacctttgcctcgggctttctggcactggcggctgagaaaacccgtgatgaggcgctggcttatccaggctatgcggaggcgtttctgcgtaaagtatgggctgataccattggttactgcggcaccgaactaattcgccgcactgtggggatgtcacacgtggcggatatgaagctgattgccgatccggcgatgcgtaccgactgcatccgtaatgcaattaatctgggacgcacgctgattctggcggccgatcatgtagaagatgtggatgcgctgattgcccgcatccgtcaggcgggataaaaaaagccgacgtgatgtcggctttcaggtaaatcaaaggctggctgtaagagtgtgcccgcgccggaaacaggggcagatcggaaagtcgctaaagccatccctggctcgctcggcccgcgtcgtcctgacgcgggacgctttcctcttctgaccctgttccctgcgccggtgatgcaggctaacgctaaaactatgctgcctcactcgcccgcgacgcagcctgaggggctttctctagcaccggcactgccagcgcatccgcctcaaactcatcgacgttaatcgaaacgcaggcggctggcctcagcacgctgcaacacttcagcctctttagcatcaatccagccctgctccagcgcgcgcttcgccagcgcatccagccgggtaaaggagaggtgctgcttcgtctgtttgcacagcctgtcatggatcacttctgccgccatcacatcctgcaacgcctgttccagctgaccggcagggttgtgctcgctgggcgtcaggtacatgccacggcccagacggctgcgggtagctgacggctgttgcagcagttttgccagctgatggtccagacggtcagacggagcagggcagtgatgaccgcctgcaaaaatagtcatccgcaatgcgcccgcgaccagacggttcgggaaattacgcagcagatcgtccatcgcgacttccgcctgatgtaacgcatcctgcacgccccagtgcaccagcggcagatcggcttcgttgcggccttcatcgtcatagcgtttcagcgtcgccgaggcgagatagagctggctcagcacatcgcccagacgcgccgaaatacgctcacgacgtttcaggctgccgcccagcaccgccatcgacacatcagagagcaacgccaggttggcactgatgcggttcagatgctgatagtaacgacgggtgccatcgcgggtcggggtggcgctggtgcgtccggcggttaagcccagccacaggctgcgcatggtgctgctgccgacatgaccgatgtggctgaacagcgcctgatcaaacgcgttaacatcattgctggctgctgccgccatctcctgcaatacataaggatggcagcgaattgcaccctgtccgaagataatcatgctgcgggtcagaatattagcgccttccaccgtgatggcgatgggcgcaccctgataggcgcgggccaggaagttgctgttacccagcataatgcctttaccgccggcaatatccatggcgtcaataatggcgcgctgaccgcgatgggtgcagtgatatttcacaatcgccgacagcactgccggtttttcaccctgcataataccggccgtaatcagcgtggccgccgcatccatcacgtatgcgttaccggcaatgcgcgccagcggctcttcaatcccttccatcttaccgattgagacgcggaactgacgacggatatgggcataggcgcctgtcgccagcgccacacttttcaggctgccggttgagttcgatggcagcgtaatgccgcgacccacagacagacactccaccagcatccgccagccctgaccggccatttgtgggccgccgataatatagtcaatcggcacaaagatattattgccgcgtgtcggcccgttctggaacggcacgttaagcgggaagtggcgatgaccaatctccacgccgggcgtattggtcgggatcagcgcacaggtaatgccaggattttcgttatcgctgagcagatgatccgggtcggagagtttaaatgccagccccagcacggtggcgatcggcgccagcgtaatgtagcgcttgttccaggtcagccgcatgcccagcacctgctgaccctgccattcgcccatgcagaccacgccggtatcggggatggctccggcatctgagcccgcttccggactggtcagcgcaaagcaggggatctcatcgccgcgtgccagccggggtaaatagtgatttttctgctcttcagtgccgtagtgttgcagcagtttcgcccggacctaatgagttaggcacgcccacggtaatcgccagaatcccggagacgcccgacagtttttgcagcacgcaggcctgcgcataggcggagaaatcgagtccgccatactcttttttgataatcatcgcgaagaaacgatgctctttcagataggcccagagttccggcggcatatcggccagctcatgggtgatctggaaatcattggccatgcggcatgcttcttcaaccggaccattgagaaaagcctgctcatcggcggtcaggcgcggctgcggatagttgtgcagcttctgccagtctggtttgccctgaaacagatcgccttcccaccaggtggtgcccgcatcgatcgcttctttttcggtgcgtgacatcggcggcatcacctgctggaagcgctgaaacatcggctttgaaaacaggctgcggcgcagtgacggcaggttgaacggcagcaggatgatcgccagcggcaacagtaaccatggcgtccagaggtgagcaaaagccatcgcagcagtccacagcagcagaatcgcgctgctgagccgcaacgacaggcggtgatagaacagggcgccaatcagcgccaccgtggcaagtatcgagacaaccatcataatgaaccgctccaagtagtaagaggtctgacctgttatgtagagaggtttagagcagttgggttgatttatcaatttgtttacatcgcaattacaacctgcctcacaaaaaccgatttctgtccatttttgcatcacccgctgcagcgataatcgccgccactgcctggccagccatggcatgacgctttgcgctgaccggccattccgttaaacttgctgcgattaaactctcctaaaaaaggacatccctatgtaccaggacattatccgctctgagcttaatgaagctgctgatacgctgaataaattcctcagcgacgaggccaatatccatgcgatccagcgtgctgcggtgctgctggctgacagctttaaggcgggcggcaaggtgctttcctgcggtaacggcggttcacattgcgatgcgatgcatttcgctgaagagctgaccggtcgctaccgcgaaaatcgtcctggctatccggcgattgccatctctgatgtcagccatctctcctgcgtcagtaatgattttggttatgactatgtcttttcacgctatgtggaagcggtagggcgtccgggcgatgtgctgctgggcctctcaacttccggtaactctgccaatatcattaaagcgattgaagctgcccgtgcgcaggggatgaaagtgatcaccctgaccggtaaagatggcggtaagatggcaggcagtgccgacattgaaatccgggtgccacactttggttatgccgatcgcatccaggagatccacattaaagtgatccatatcctgatgctgctgatcgaaaaagagatggtgaagtaactgcgctggcctcccgcctgacgggaggccgcttactctaaggcggtggctatgtgcgaattgctcgggatgagcgccaatgttcccacggatatctgtttcagctttaccggtctggttcagcgtggcggtggaaccgggcctcacaaagatggctggggcattaccttctacgaagataaaggttgtcgtacgtttaaagatccgctgcctagctttaactcgccgattgcgcgtctggtgcaggagtatccgatcaaatcgcattcggtggtggcgcacatccgccaggcgaatcgcgggcaggtgtcgctggaaaatacccacccgtttacccgcgaattgtggggccgtaactggacctatgcgcacaacgggcagctcaggggctatcggcagctggagactggcacattccggccggtgggcgaaacggacagtgagaaggcgtttctgctggatcctgcatcagctggcgacgcgctatccgcgcacgccaggcaactggcctgcggtatttcgttttatcggggagcttgccggcacgttgcggcagaagggcgtgtttaacatgctgctgtcagacggccgttatctgatggccttttgctccaccaatctttactggatcacccgccgcgcaccctttggccgggcgcagttactggatcaggatgtggaggtcgattttcagcagcacaccacgccgcatgacgtggtgacggtgattgctacgcagccactgacggccaatgaaacctggcagcggattgtgccaggtgaatgggcattattctgccttggagagcgccaggaatgaacgtgaagcggcttcgggactggctaaaaccggtgccgggctgctgttcatcacatacttaccgctggcgacattaaccatcggcggctggtgatatttggcaaagtaagcgtatcccggctgcagctgctgccagaaactggcataggtggagtagcggtgacgctgcatattgctgtcggtcatgcggaatggatagatgctgatgctgataccctgctggccgttacgcagggcggcattcacatacgtaaaaatctcatccatataggcgttagtcatggcatagcagccaatcgacttacagtcgccatggatcatcaggtaattgccgctgtagccctgattacgatcgtactgattcggaaagccgatgttgatcgcgcgataaaaccggctatccggcttcagctgattcagcttcacgttgtaaaaaccttccgggcttttgaaatcgccttcacgacgtttcgggccgaggccgccagaaaagttacagatgcggtaggtgtccagcaggcggtattctttaccgattttgccgtagagttcgagcgtgcgttcttccttgaagatctggatatagaccggggtgccaagtaactgcttctttaattctttgctgaccggtgccgttgagacgggttcgggtgtcattgccatgctgagggctggcagtaaaatcatcgcaaacaggagtgcgattttgcccatgctgtgtgtaccttgaggtgaagagaacatgacgcaaaatgtgcgtctctgtttgcattatcggaactgtccgctaccgcagcgcaacattaaacattgtctgtttttttagcaagacggcgtcagccaaattcgcgatttactgaaagatattcggccagaaatttgtaaactttaatcgtcagcgcgacaaatattgcagttacccctgccaactgtatacttatccagtgccggagggggtatgcgtaaaatcattcatgtcgatatggactgcttctatgccgcggtggagatgcgtgataatccccagctgcgcgacatcccgatcgccattggtggcagccgcgaaacgccgcggtgtgatcagcaccgccaactatccggcgcgcaaatttggcgtgcgcagcgcgatgccaaccggcatggccctcaagttatgcccgcatctgcgtctgctgccaggacgctttgacgcctataaagaagcctccgcgcagatccgcgacatctttacccgctatacgccgctgattgaaccgctctcccttgatgaagcttacctggatgtcaccgacagcccccactgtcacggctctgccacgctgatggcgcaggcgatccgtgccaccatctaccgtgaaaccgggcttaccgcctcagcgggcatcgccccgattaaatttctggcgaagatcgcctctgacctcaataagccggacggccagttcgtgattaccccgccggagatgtccggttttctgctgaccctgccgctggcgaagatccctggcgtcggcaaggtctcggccaaaaagctggaagagatggggctggtgacctgtggcgacgtgcagaaggcggacttagcgctgctgttaaagcgctttggcaagtttggccgggtgctgtgggagcgcagcaatggcattgatgaccgcagcgtgatcgttgagcgcgagcgtaaatcgctgggggttgaacggacgctggcggaagatatcagcgactgggatgcctgcctggaaattatcgattttctctacgccgaactggaacgccggctgacgcagatccgacctgacaagcaggtggcgcgacagggcgtcaaactgaagttcagtgattttcagcagacgacccaggagcatatctggccggtgctgaataaagaggacatgattgccatcgcccgtaaaacctgggatgagcgtcgtgccgggcgcggcgtgcggctggtgggattacatgtgactatggtggatccccagctggagcgtcagctgctgctgggtctgtaaccgtcagcctcaccgaccggcaaggctgacatccgattacttcttatatttcgccgccagggtcgcaaaccacggggcaacgaaatcctcattgctgccccagcccggaatgatcttgttcagtgacgcgacgttcaccgcgccaggctggctgttaagctgctgctgagagatcgatgccgctttaaactgataagtcgctggtgtctcttcaccggcaattttcttcgccaccagacgcatattcaccgcgccaatagttttaggatccaccgctaccgtctgcacccacgggctgtttttctcgcgcatcagctgcaaatcctggttcgaaacatcaatgctgtagagtttgatctcggtacggccattctcctgcagcgctttgtaagcgccctggctgaaggcgtcccaggcaccccagatggcgtcgattttgcctttcgggtatttcgccagaatcgcgccaattttattggcggtgtcgccctgaacgtcagttgaaaccgcaccaatcgactcaagctgatgaatgcccggattctctttcagcagtttttcatacaccacctgacggcgttccatcggcgggaaaccggcaacccatagcttgacgatgttcgccttgccgttgaaatcatggatgagctggcccagcgacaactgcgccagtgaagcgtcatcctgcgcggtgacggtgacgcccgggatcgggctatccaccggcgtatcaaacaccgacagcttaatgcctgcatcggcaatgcgcttcaccagtccgctggcgtagggcgctttaccgtgcgacagcacgatgccgtcatatttctggctgatcgcctgattcacgaaatcctggaagcgcgcatcgtcgccgttgctgagaaaggtgctgaccttgaagccaagctggcgaccctgctgaatggcaccggcaacaaactgggtggtgttgtcatcggagccgagattgcggatcaccgcaatacggatcgggccatcatgactggcgatagccgcaggcaccggcgtgacggtatccgcgaaggcggcgctggcgttcagcaggctcagggccagcagcgagagtgttattttttgcattgttatcaactccggtaaacgcgcctcagcggcgctggatataggtgatcgccagtgctaaagccagcaccagccctttaataatgtccatggcgtagtagggaacagagagcatcaccagaccgttctgcagcacgccgaggatcaccgcaccgaccagcgtgcccagcgcattcggcttgccggaacccgccagtgagaagccgatccacgccgcagcgaccgcgtccatcaggtagccgctcccggcattgacctgcgaggagccgatacgcgaggcgagcagaatcccgcccagaccggccagcagtgaggcgatcacataagccagcacccgatagcgggtggtgcggatgccggagaggcgcgctgcttccggattgccgcccagcgcatacatccggcgaccatgtttagtcagggagagcgccagctgcgcggcgacggtgacgaccagcataatgatgacgatggtgggcacctggccgagcaggccaaacgccgccggaatggtgccttccgccatatcaccgctcggcagcaccatgttctcggtgatcgatccgccaaagctgtaggtcatcgccacaccctgaatcacgaacagtgtcgccagcgttgccagcatgtcggggatgcgcaggatcacaatcagaaaggcgttaaacagcccgaccagggtgcagagcgccagggtgagcaggatggcggtggtagtgccgaagccgtaccagacaaacagagaaatcaccagtgcattggccagcgaggcggtcgatccgaccgacagatcaaagccgccaacggtcagcgagatcgagacgccgatagcaatcaccgtgacaatggcaattgagcgcagaatattgatgatgttgttgggttcaaggaagctgtcggaggcgagaccaaaagcggcgatcaggatcaccaccgtgagcaacatgccccatttatagagaaagtcgaacaactggtgacgccacggcgaggctgtcagattcaggctggtttctttgctgctcacgcaggggttcctccggtggaatagagcaaaagcgtctcttcggtgacgtcgcgtgcagccagctcggccacaatgcgtccatcccagagcacgcaaatccggtcgcataaaccgaccagttcagaaaactctcccgacgcgtaaatgatgcctttcccctcgcgcgccaggttatcgatcagggtgaagagttcggttttggctttgatatcgacgcctttcgtcggctcatcgaaaatcagcacgtcggcgttgttgcgcagccatttgcctatcgccactttctgctgattgccgccggagagacggcgcagcgtctgtgccggaccggtggtgcgcacctgcaactgctggataacctgctccgcccagcgccacgcctggcgatggccaaacaggctccagcgcgaaaagctgtcgtctgcgctgacgctgaggttcattgccaccgactcatcaataaagatcccctctttgcgccgctcctccggcaccagcgccatgcggcgactgacggagtcatgcggcgaacggggctgccacggctggccatgcagttcaccgcgactgacgcggcttttgctggcaccaaacagcgccttacagagttcggttttaccggcaccggccaggcctgcaatgcccagaatttcccctttgtgcaatcgtagcgagatatcctgcagcagttgctcatcatgaagaccgtcaatcgccagcagcagcggctgagtctgctgcgcacgacgggccgggaagatatcggtgagctgatgccccagcatcttctccacgatctgctcaccgctcagtgccgccatcgggccggtttcgatcaaccggccatcacgcagcaccgtcagctggtcacagattgctttcagttcatggatgcggtgagagataaacaccacgccgatgccgctggcctgcaggcgacgcaccacagcaaacagccgctcactttcatgctgatccagcggggcggtgggttcatccagaatcagaaagcggcagtggtgcgacagcgcgcgcgccagcagaatttgctgcttttcagccagggtacagcgctccaccagccggttgacgtccagcgccacgtcgagctgagccagcagcgcccgcgcctgacgccgaacctcgccccagcgatagcggtggccaggctctgccagccgatccagcagaatgttttctgcgacgctgagctgcggcaccagcgccacgtccacttcctgctgaaccagatggatacccagccgtttcgcatcacgcggcgtgcggatggagaccggctcaccatccagcaggatctcgccgctgtagtggctgtgcgcaccggaaaggatcgccatcagtgttgacttgcccgcgccgttagcgccggtcagtgcatgtactgaatggccgtcactgcggaaatccaccgacgatagcgcggcaaacccgccaaaagcgatggagatgttacgcatctcaaggcagtttaaccctggcatgtcattactctcctgaagaaacactggccgcattttttcctgaaccttcaggcgcggcaacagccgaaagcgcataagctagcacgaaatcttattagccatccagacatctggacataatggcggctgtgaccagcgaagcgcgggaaagcggcggaataacggggtaaaggacggaaaaggcagcgaattatgctgggggaaagtcacaggcataaaaaaaccaggccggagcctggtttactttttttgtgacagaattacttttctggcaccacattcagcagggtggtcagcagtttccagtaaaggccaacgctttcgatgtgaacctgctcatccggcgagtgcggcccggtgatggtcggcccaatcgataccatatccatctccggatacggttttttgaacagaccacactccagaccggcgtggatcacctgaatgttcggggtcttatcaaacagcgcgatataggtctgacgggtcagcgccataatggcggagtccgcatcaggctgccagcctgggtagccgcctttcgctttggtctgtgcaccggccagctggcccagtgaggtcagcatctgcaccacataatcgcggccggtgtcgatcagcgaacggatcaggcagttgatctctgcatgatcggcttccatggtcaccacaccgatattcagtgaggtttctaccacgcctttcgccacgtcggagttgcggatcacaccgtttggcatgctgttgagcaggttcaggaagcgatcgcggctgtcagcgttcagcgcatcaccctgatgcgccagcggctcagtgaccagtgcgatgttcggctctttgatgccgtgctcatttttgatggcgctcaggaagtgcgccgccgctgatttcagcgcatccgctttgtggctctcgaccgccacggtagcgaaggcttcacgcgggatcgcgttgcgcagcgtaccgccgctgaaggccagcagacgcagatccagttcagcagcgtgtgccgccaggaagcgcgccagcagtttgttggcgttgccgaggcccatatgaatatcggcaccggagtgaccgccacgcaggcctttcagcgtcagcttcagggtctggaattcagcaggcaccgcttcacgggtcagtggcagggtggtgacgaagtcgataccgcccgcgcagcccatgtagatctcaccttcttcttcggagtcggtgttgatcaggatttctgcctgcagccagttgggttgcagaccgaatgcgccatccataccggtctcttcagtcatggtcagcagcacttccagcgggccatgcgtcaggctgttgtcagccagtactgccagcgcagaagccataccgatgccgttgtccgcgcccagcgtggtgccgcgcgctttcacccactcgccgtcaacccagggctgaatcggatctttggtgaagtcatgaacggtgtcattatttttctgcggcaccatatccagatgcgcctgcagcgcaaccggggtacggttttccatgcctgcggtggcgggcttacgaatcaggatgttgccgacctgatcgcgctcacaccagaagccttgctctttggcccagccgacgatgtaactcgccagcgcttcttcgtgaaaagagggatggggaatagagcagatcttagcgaaaatatcccacagcggctgtggagagagttgagacaattcagacacgacaggtctcctgtgtcagtgtaccggcgaggccggacatcgcgagtttccagtgaaaaatcgccgtcagagaatctgacgagccaggcccgagaatatcactgttttctaccgggtgcgctctcagacgcgctaaaaagccgcaaccagtgcgcgggtgctggtttttagtgcgtcaactccttataatctcgcgcaaccttttccccgttgcacatttttacgccacctcggttggctgggatttctattctatgagcgaaaaatacgtcgttacctgggacatgcttcagattcatgcccgtaaactggcccagcgcctgcttcctgttgaacagtggaaaggcattatcgcggtgagccgcggcggtctggtaccggcttcgctgctggcacgtgaactgggtatccgctacgtcgataccgtctgcatctccagctatgaccacgatcatcagcgcgaaatgaaagttctgaagcgcgcagaaggcgacggcgaaggctttatcgtgatcgatgacctggtggataccggcggcaccgcccaggcgattcgcgagatgtacccgaaagcgcgtttctgcaccattttcgctaaaccggccggtcgctcactggttgatgattatattgtcgatattccgcaggatacctggatcgagcagccgtgggatatgggcgtggtctacatcccgccgattgttaaaagctgattgatatgcatcagacaacgcccggttttccgggcgttgtgctttctgtgcctcgcaccccgaattgccgtacagtacacttagccatcgccgtttctgttgcaggagaagtgagtatgtcgagcaaaaatctcagcgaggagttgttcaaaccgcgctttaaacatcctgaaacctcaaccctggttcgccgccaccatcatgctacttcggatgtccactcagccctggatggtgacagccagcgtggctggtatcgtatgctgaataagctgatgtggacatggcgtggcctgacgccgcaggagatcagcgaagtactggcacgtattgccatcagcaatgttgaacatacggatgagacgctgctcgacactgtaatcggttttcgcggcggcaactggcatttcgaatggtgtaaacaggcgggcatctggcagcagaaagcgctggaggccaccgacgacagagaggcgggcgactactggctgcacgcggcgcatctctacagcgttgcggcctatccctatataaaaggggatgagctggccgaccaggcgcagacgctggcgaaaccgcgcctatgaagaggcgactcaacggctgccaggcgagctgaaaccgctgacgttcgccattcagggtggcagcccggttaacggctttctgcacatgccgcctgacgttgaagcgccttatcccaccgtgctgttctgtggcgcgctcgactcattacagagcgatcactatcgcctgttccatgattaccttgcaccgcgcggcatcgccatgctgaccattgatgtgccgtcggtaggcaactcggtgaaatggacgctaaatcaggacaccagctttctgcatcagcaggtgctgcgcgatctgaaaaacgtgccctggatcgaccatacccgcgtggcggcgtttggttatcgctttggcgctaacgtggccgtacgactggcctatctggaatcgcagcggctgcgtggggtcgcctgtcttggcccgattgtgcatgcgctgctgacgcagacagcgttgcaggatgagatcccggatatgtatatggatatgctggcgagccggctgggcatggcaaccgcttctgacagtgcgctgcgtaccgaactcaatcgatattcgctgaaaactcagggattgctgggccgccggacgccgacacccatgctgtcgggctactggcaaaacgatcttttcagcccggaagaggagagcaagctgatcgctaactcttcgtcagatggcaaagcgttgctgattccggtgaagccgatgatggccagtttcgacaaggcgctgaatgaaatttgcgactggctggagaagcgtttaaaaaggtaactggcaaaatttacagtatttgctacaactagtagcggaattcttccgggctgccgttaagcgaaacatgacatcccctggccgtccggaaaatcaaggctgtatagcggtcaaaatctatggagattcagcatgacgttaccaagtggtcatccccgcagtcgcctgcttaagcgctttacggagcttgggccttatattcgcgatgggaaatgtggcgaaacccggttctttttcgactgcctggctgcctgcgttaatgtgaaaccggcaccggaactgcgtgagttctggggctggtggatggagctggaagcgcaggctgaccactttacctatgtctaccatatcggtctgttcgataaagagggtgactggtcggtggcaaccatcaaaggcaaagagaatacggcgcgcgtggaagagaccttacggaatttccatacccgtctgaaagcgatgctgaaagagttcgagctggatctgattccggccagcgatttcgatgagaaaccggtgaagctgagtgcctgattgggtgtttagagattaaagggtgagttaaaacgcttgcccacaaactgctgacaaatctcaagtagggtgaatctggcagcaacgaataagctcaacacgcagggaacacgggcagaagaggaaagcgtcccgcgccagggacggcgcgggccgagcctgtcaaggatgacgtcttttgcgtctttccgatctgaccgtgttccctgcgccagctcgatctcatagcagagcgggccagatgctgttaacaagcaaagggcgcgttgaaaaacgcgccctttttcatgctcacacattctgtagcttatgctgtgcggcattagcctgaaatcagaactggtaagtcacacccatcgcgaccacgtcatcgttgttaatcgacagcgcgttgtcatcatccagctggttgattttgtaatcaacgaaggcggacatatttttgttgaagtagtaggtcgcgcccacgtcgatatatttcaccagatccgcatcgccgataccgttttcgatatctttgcccttggtctgtacatagccaatagaaggacgcagtccgaaatcaaactgatactgcgccaccagttcgatgttctgcgctttgttggctgcgcccgcgacggtagcaccggtgttacggttggtgccgctgattggtgtcatgttgcgggtatcggtatagatcgccgccaggtagacgctgttggcatcatacttcacgcctgcgccccaggaatccgcacggtcaccgccgccataggcacgtgcctgctgctggttggtacggtcagaagaggtgatggcactcatcaggctcacaccggaatcacccagggcatagcccagtgaggcaccgtagccgtcgccattctgacggttgatgtcggtgcgggtgttggcgctggtggcgtcgtttttaccctgatactgcaacgcaaacttcagcccatcgaccagaccaaagaagttgttgttacggtaagtcgccacaccggtagcgcgctgggtcataaagttatcggaaacgggctgtaccgtcaccgccgaattccgggaacacgtcggtccaggcctcaacgtcatacagcacaccgtagttacgaccgtaatcgaccgaaccatactgcgagaatttcagaccagcaaacccaaggcgggttttgttgccattgttggcgtcgctgccctcggagttattgacgttgtactgatattcccactgaccataaccggtcatcaggtcgttaatctgtgtctgacccttaaagccgatacgggtataggacttgtctccatcctggctggcattatcgctgatgtagtgctcagctttaactttgccgtataagtccagtttgttgccatctttgttatagatttcggcagcctgcgcggcggatgccagcgtcagcgtggagaggatcatggccagtgtgcttttcttcatttgctatcaatcccaatgtgaacgccgtaaaaaaatgaaagtttttgtaaagcacggactttttacccgtcggcgatgaactttttatgacacttttcatgatttcttgttaactctgaacttttggtctacgtccttgtccgcgtaaattcgtgcttttcccccgctggctgttggcttccttatcgactcctgttaaaacgtcctttcgtaaaaatttttcactacggcaggaaatatgagtggcagtcagaccttagtggtcaagttgggtaccagcgttctcaccggcggctcccgccggctgaatcgggcgcacatggtggaactggttcgtcagtgtgcgcagcagcacgcggcgggccaccgcattgtgattgtgacctctggcgcgatggccgccggacgcgaacatctgggttaccccgaactgccacccaccatcgcctcaaagcagctgctggctgcggtggggcagagccgtctgattcagctgtgggaacagctgttctcaatctacggtatccatattggtcagatgttgctgacccgtgccgacatggaagatcgcgagcgcttcctgaatgcccgcgacacgctgcgcgcgctgctggataaccacattgtgccggtgatcaatgagaacgatgccgtcgccaccgctgaaatcaaagtgggtgacaacgacaatctctcggcgctggcggcgatgctcggcggtgccgacaagctgctgctgctgaccgaccagcagggactgttcaccgccgatccgcgtaacaatcctgaggctgagctgatcagtgatgtccatgtgattgatgatgcgttgcgtgccctggcgggcgacagcgtatcgggtctcggcaccggtggcatgtcgaccaagcttcaggcggcggatgtcgcctgccgcgccggtatcgatgtgatcatcgcctcaggcagtcgcagcggcgtaatcagcgatgtcattgacggtaagccggtcggtacgcgctttcatgcgcagcaatcgccgctggaaaatcgtaaacgctggattttcggtgcgcctccggcaggtgaactcaccgtcgatgatggtgcgctggcagcaattattgaacgcggcagttcgctgctaccgaaagggatccgtgctatccaggggaatttctcgcgtggagaagtgatccgtatccgcagtttgcagggcagggatatcgcgcatggtgtttcacgctacaacagcgacgcgatgcggatgattgccggtcatcacagccagcagatcagcgaaatcctgggctatgaatatggcccggtggcggttcaccgcgacgacatgatcgtcagttaaggagcggacaatgcttgaagagatgggaaaagcggcgcgcgccgcagcttacaccgtggccgatctgtcgacggcagagaaaaatcaggttctgatgactattgccgaccgtctggaggcggaaagcgcagacattctggcggccaatgagctggatttagccgatgcgcgtcagaaacggcatgagcgccgcgctgctggaccggctgacactcaatccgcaacgcctcggcagcatcgccagcgatgtgcgccaggtctgccagctggccgatccggttggacagctaattgacggcggtcagctcgacagcgggctgcgcattgagcgtcgtcgcgtgccgctgggcgtggtggccgtaatctacgaggcgcgtcccaatgtcacggtggacgtcgccactctgtgcctgaaaaccggcaacgccgccattctgcgcggcggtaaagagacctggcgcaccaatgcggccacggtacgagtgatccagaacgcgctcaaacagcacggtctgcctgcggcgatcgttcaggcgatcgaaaatccggatcgcgagctggtgaatcagctactgaagctggatcgctacgtcgatatgctgatcccgcgtggcggagccgggctgcacaagctgtgccgggaaaactccactattccggtgatcaccggcggcatcggcgtttgtcatatctatattgatgagacgatggagatcgaaccggcacttgatctgatcgtcaacgccaagaaacagcgtcccagcgcctgtaactcactggagacgctgctggtggatcaggcgattgccgatcgcttcctgcccgccttcagcgcgcgtatggcacaggaagcgattgcgctgcatgctgacagcaacgtgctggcgcagctgcagcaaggcccggcatcggtcacgcaggtgaatccgcagcagtacaatgatgagtggctgtcgctggatcttaacgtcaaattagtggcggatatggatgaggcgatcgatcacatccgtacgcacggcacgcagcactcggatgccatcctgacccgtaatacccgcaacgccgcgcgttttgtccgtcaggtcgactcctcagcggtctatgtcaacgcaagcacccgcttcaccgatggcggacagtttggcctgggtgccgaagtggcggtcagtacccagaaactgcatgctcgtggcccgatgggattagaggcgctgacgacctataaatggatagcatggggcgacgatacgctccggccataactgccataatttttaacaaagcgggagtctttcagagactcccgttttttttagctccattttccggtccagtgaaagatagagttttctgcgcatcagcttaatttccgttccggtctcgtcactactggccattattctggctgatattcacgcaattttttacggaacattcctgaaagccggggctgtacgcggcctgaggcaatattttttgtccagccgcgggctgaagcggataatgattatcaggaatgcttgataaagcggttaggtagtaaacgagcggtaatataaaatgaactggtagcaataatgaaaataacatccagtatctcttctatggctgattattaactaatggttaaaaaagaaagtacaagacaagctttcaccgccaggctgatagcggcctgtgagagtgccggcattgccggacatggacgaaacaaacaggttgccagggctctgcagcagcaaggctgtaagatttcaacgccgggagtgtggaagtggtttaacgcgcagtcagtgccggatggcggcaatttactggctctcagccagctgctgggcgtcagggttgagtggctgcaatacggtatggaacaacctgctgaaaccggtgacgctaagtgcgctcaccggtcagaagaatgtgtttcggattgatagcctcgacattggtcagcgaagtgctgcaggcctgcccgcgcgtgatgagtttgtcgagactatccaggcgatcgaatatggtctggatgaggcgcgggtgctgttcaacgggcgcccggcggaaaacatccggttaatcgctatcaacagtgactccatggctgacacctttgcgccgcgcgatcagctgtttgtggatatcagcgtgcggatgttcgacggcgacggcatctatatttttaccctcgatgagcagctctatctcaagcgcctgcagctgcagcataagaaaattgctgtgatatcagataataagcgctatgaaacctggtatctcaatcatgatgacgtcaccagcctgaaggtactggccaaagtgatcatgagccaggcgcgacattatcaaatcctcggttaaggccacttctgccggttttttcaggaaggctgaaaaaaaaataatcggcataaattcataaatttaaccagcggtaaataaaaaattaaccaacagtgtttgataaagcataagaacctgttaataatttggatatggatgaacgaagcagttctttcagggacgagccgctcttaaacaattgaggcgctgcacaagcgcgaatcataccaccacaaagttagtgaactttgggatggggtggatgcgcaaaatgcagcgtcgtcagatgccgtttatttcccctcgcttactttccacctgactgctaatgcagccgggcggtaagcgtgcgaccgtgatacgcgacattcgggcccgttcggtttcgccgaaagctcgcgcctgccaccccatcgccaaagactcattcacaggaggagttatggcgataattcactatggcaaaagcgtttttataggcaacgcacgtactcgtcgccaccggcggcgccaacctctcagcagcctgacacagagcatcgacgaggccctgaacttcccaactgaaacacccaccctgagacgtgcagagcaaatctgccagcgtcaggtcgccccgcgcgttgaccgcgcaattactgcaccccgcgtcaccagtcaggaaacacccagtttcgacaattgctgtcttccgcacgttcatctctacgccgtgagctgaaacgcgcagaaaacgcatttttccgttccggctaactcttcgctttctccagttctcactgggcgcaatttgctgaattactgttcagttttgctgcagggtcagtaaggccttctgctgcgccgtgctgagtaatgatcagcgagcgttatgtatttcttttcacaaggctgagttgctttaacccgtcattgaggagtcgttatgagccagataatcgcagtactgaattttgaagaggggtatgtcgacacgccctatctcgacacgctgggctttcccacggtggccggcggcattcgcattggacccaagggggcgtctctgagtaattacgctttccgcgtgccacggcgcgtcggtgatgtctggaagcagtgcattcttgaaaacaaaattcaggagatgcagggcagggagctgctgcgtaatgcgctggcgaagtgcaacgacgcccgcaccgacgtgctgctgagcatggcttatcagctgggcgtcgagggcgtcctgcagttcaaaaacatgctcagcgcgatcgtggctgaacagtttaatgatgcggctgacgcgatgatgaacagcctctgggcccgtcagacgccgggccgcgccagacgtcacgcggagatgatgcgcagcggaacctatgcggtttacagggggttgctatgagatggctcatgtttctcaccgccgtgctgacggcaatcatcattctgctgctgctgcagcgctttaccaccctccagtttgtctctcatgcccgtctgcttttcaaaacctggtctgtctggcttgcgtcgctgggttccatgctcagcgcctgggcgcagtcgtttccttcggccgccgttgatgcctggagcgcactgcccgaagacgttaaagcgattctgccgcacaactacctcgggctggtgggcgccttcatggtggcgatgggggtgattgcacaatttgttcgtcagaaaaacctgctcaatgcgaaggagcagtctgaaggagcgaagccatgactctgattaccaccttactgggcggcagctggcactggatcgccgcgctggctgcggtcatcgcggcgctgggcgccagttatttcggcggcaagaaaatcggcaaagtgcagcaaaaagcgcgttctgacgtcgataacgcgcaacaggaggcgtcccgcgtcaccgcggtagcgcaacagcaacaacataatcgcgaggaggctaaccgtgtggcgactgacaaccatagccttgatgacgctgctgctcgcgacaagctgcagcagtcgaaataccacaaaccctgagccggtggcgatcaccgactctgcctgcgtacttttttcccctctttatacctacggcgatgacgcgcaaaaaatggacgttcgtacggtgcgcgccatcaacacccacaacgacatgtgggactccctttgcggccatccggctgcggctaagtagtgcgctgatttcagcgcgatatctctatgatcctgaggaggattctatgatcgaagttaactcttttgctgaactgcgtaccactgttccaccaaaatcaggtgaagtcgcgagccttaaacgctattacgataaggattccagcttccgtggtggcgcagactttgttggtttcctcagcaccactccgctgaaagatgatggcggtacggtggcggtgggtaacggtttctactggaagcgcaccatcaacgatcccgccgaagtaaacattctgcactttggcgcgaaaggggatggcgtgaccgatgacactgaagcctttaagcggatgctggcatggacacagtcttacaacgcctacgcgaaagccattccggtgcgttttccggggggccgcttcctgatttcacccatcgatatcagcgatacggagttgtcgttttttggtctggcaggcgatgatatcgagctcggctcggcaccgcgcaccaccattgtttctgataaaagcgcgaataccgtgtttaaggttaatgcgcgtcgaatcgtcattaaaggcatctgctggcatggacaggctaacgccgggactgtcgacaccgcggccaaagtcaccgtcacgcctgaacagtgcagtaacacgcagccgttctttgaaaataccattgtcggaggccagatcgtcaatatcttctgcttcaaggcgcaaagtaccgggggaaccgtctttaagctgcaggatacgctcgacagtaagttcgatcagatttacagctccaataccttttcacgggtatttgatgtcggctggtcaaacacaccgaaggggaactgggaccactcaaccgccattgagctgtgtaatgccaacttccagtcgggctatggcgacgcgacgctctatatgccacgcgtcacacaggggctcatgcgtaacgtctggattgagcacacgactaacccaggagatctgtcggatggcggctggaacatcgaaacgctcaacattgaagattgcggcacgccgctcaatctcaataatgcccgcgtggtgatgcgtcatatcaacctgcaggcgggggcgaaaatcaccaatgatctggccggaagtaagtggttatcgaccttcgaatatggctatcgtcgggatgagaactacggcacgttcatgaccggttcgctgcgtgccggctactacagcggctataaagtggtgaacaacaccgataccgacaactggtatcggctggggcagctctatttcccggcgcctaaccagcaatgggtaatggagctgatcgggaaagcggatgcgaccacgccctccggcaccgccggttcgccggttaatgtggtgggcaccggtaaaaccctgatcaacctccagcgactggagacggtctgggcggatgcttaccatatgggtcagccttccgtgctggacattcgttatggccgggtagggaccacctatgccgtaatctgggtcaagctgagagcgaacagcggcgaaaccatgttcaacctgaagacgacgggtccgacccgcttcgataccggttcctgctcgctgttccaggctgatatgtcggtggttacggacatcaccaaaatcagcaacctgaaacccgctgcacgttttggcatgcacaacgggctggcgggcatcggggccaacgaaaaaggggtggttacgctggctaccgcagcgggtacgccgaccaataagaccgctccgaccggttttgtgctgatcaatatcaacggcgttgaccgtaaggttccttactacgattgatgatcggcatgttttgggcgaggctccggcctcgcccttttttgatctgacattatctccgcttctttttacgtcgccagaaaagtcaccgctgcactgtgaagccagacagtctccctgacacagcctttcgccttcatcctcgtcaacgggctgattgcgattaatttgaattacggcttgcgtcactttaagaagtgtggcctaatgaatcgtcggtttgattaacagacactatcaaagtaagtaaccaaagcagttctcatctctaagtttgtcgcgagacatcccttctttttgagtcttctcttacgttctgattaaaatctgttctcaggccattatgtatgccggaaggctcgatatattaaggatttaagcatgtctaacaaaattcgcggtaccgttaaatggtttaacgcagagaaaggcttcggtttcatctctcctgcagacggcagcaaagatgtattcgtacatttctctgcaatccagggcaccgatttccgttcattagatgaaggtcagcaagttgaattcacagtagaaaatggcgccaaaggcccagctgctgcgaacgttgttggtctctaaggactgaaaattacttttaaatgtcctcactgtagtggctcacagtttcgtacatcacattttgatgttacaagagccaacccgcatggagcgaaatgcattttctgcaaatctgtcgtggttcaggtgaacctggcaaggattgcaattcagagccagcttcgcgctctctgattaaggctagtgagctttatagcgttgttgcatttacagtaataaaaggctgcctctggcagccttttttgtttctgcgtttctcccttctcaaacctcacgcttttttccttgtaacctgcctgtttaccttcattttcgctgtttagttgcaactcccttgtataacgttcatcgcttcccgcttcccgcttcccgcttcccgcttcccgcttcccgcttcccgctctgttgcctgtaacctatccgcccttatcgtcaccattcttaaactggcccgccgaagcaggccgttgagagggattaacgcagtacgggttgcagtgagagcttgccggtattaaagacgctcatcgcctgtgccatacgctctgcctgatcctgcagcgcttgtgaggcggctgacgcttcctgtaccagcgcggcgttttgctgcgttaccgcttccatctgcgtaatcgcctgattgatttcattgatgccgctgctctgctcgctgctggcaatggtgatttcgctcatgatgtttgccacgctctgcacgctgttcactacttcgccgatagttgaaccggcgtgtgttaccagcttgctgccttcatcgactttagcgacggaatcttcaatcagtaccttaatctctttggccgctgaggctgagcgctgcgccagattacgcacttcactcgccacgaccgcaaagccacgaccttgttcacccgcgcgtgccgcttcaaccgcggcgttcagggagagaatattggtctggaaggcgatggagtcgataacgctgatgatatcgacaatttttcgtgaggagagggcgatcgcttccatcttctcaatgacctgctccatcaccacgccaccttcacgcgccacgctggaagtggttgaaaccaggtgattggcttcacgcgcgttgtcggcattatgtttcacggtcgacgtcatctgctccatggcagaggcggtctcttccagcgaactggcctgctgttcggttcgggtcgaaagatcaaggttcccgctggagatctgattagaggccaccgcaatagtgtcggagccggtacgcacttcagtcacaatcgacagcagattatcgttcatccgttgcagcgcctgcatcaggacgccggtttcatcgcgtgaggtcacctgcatttgtgaactcagatcgcctgcggcaacgcgttcagcaacgtcaaccgctgcaaccagcggacgcacgatagaacgggtcaggaagtagcccagcagaatagacgccagaatcgccagcgcggagaaaatcagcgtaatggagatagccgactgaccattttccacaataccctgaccttcactgcgcaactgtgcgtcctgagagttggcaaaatccacggcatcctgaaggaatttgttctgggtggcggtcatcgatttcaggacataggtgctggcagcctcaaaatcgcccgccttcaccagggtgatcagctctgctttaactttctcaaaagcctgcgaagaggccagcagaccggcgatctttttcttgccgaccggcgtgacctgaatatcttcgatccttttcattgcgctgttggtgcgttgcgtggcttcatccagctgaccataacgcttcacattcatttccggacgtgtcgtgtcgatcaccatgccgcgcaggtatttgatctgatcgttgacgccatcgcgcacatcaaatgccagtcgtactttcacataacgatcgtcaacgatcgaggcgatcgccgtattaatgctgttaatcctggttatggatgtcacgccaatcactatcagtaacgtcacaataataccgaaggctgctgcgagccgcattcccaccttcatattcttgatactgaacatgttctcttccccgttttattattaatcaatttgttagcaacactcaggtttcctgctgttgtgcgcagtgccttgctgatgtctgtggtcacagcctcaggcaaaaaggtgatctcgcgcatactgttatcggagcacgaagttgtacctttaataatttttaagtaataacgccgggtgaataaatagtcagtaaaaatcatcagaaacggttaagtaataaccagaggaaattcagacaaaaaaaagggctgtcagcagtgatgctgacagcccgatccagacaaggatgaatggattcagaaaactaagaagtagaggcctgtccagaacgcgacgcttaacgtgacggcgctaatccaggccagctggcgtaaacggccacgcagcaccttttgacgggaaggcgtagcaggtgcaggcgtaacgggtaaagtttcaatgtgcatagtcggttcctgatcaggtcagccattccgctggctaaaaagtaaaagcgtgccgggcattcttagcggcccgcattcgcttagcgggcagtgtcgagaacgttgaaaatcacgtctgatagctcattcaactcaaacttcgccacataaccgtcggcacccactttgcgcacatgatcttcgttggcgctgccagagagtgaggagtgaatgacgactggcagagccttgaggatcgggtcacgcttgatgttgcgggtcagcgtaaaaccatccatctctggcatttccagatcggtcagcaccagggcgattttgtcgtgaatcgattcgccggcagcctgcgcttcctggctcatcaatttaattttttcccaggcatcgagaccggtgttaaacatcagcgccggaatgcccatactcttcaggccctgctccagcagctgacgcgcgactttggaatcttctgccacaatcgccaccgcacctgggcggtagttgaaggcacgcggtctggctgcttccggtttcgacgccgcgcactgatgggatgatgtcatacaggatttgctcaacgtccagcaccatcgccagctcgttgctctgcttgtcactgtccaggcaggcgatgctggtaatgttgcggccgccgataccggcttcggcggtatgcacctggctccagtcgagacgcacaatgttctcaactgactctacggcaaacgcctgggtgttacgggcatactcggtgaccagcagcaggttaagaccggtttccggcacacaacccgccacggcaggcaggtcgatgaccggaatgaactggccacgaatacttgccatacccagcagcggcgaacgcatgcctgcggctttggtgatagttggcatcggcacaatttcacgcagcttgaagacgttaatgccaaacagttcagacttgcctttcagctgatcggaacctaagcgaaacagcagcagctcaaacttgttcgataacgcgaggttcgctctctcatcgatctctttctgaaaattatccatggttgcctctgcattaacgcagctggtgaaatagggtgtgaacaggttatcggcagcaaacggaaaaaggtgagaagagaagggtgaaataaaacggacgccaattaatgtgccaggattaaccctgaaggttcaacatggacacctttccaataaaggagtgtgaaatgaaaaaagtgattctggcgtcgttgctggtgatgatgagtgcgggtgtttcggccgaagagggcggatacaaagcaggcgatacgccaccaccgcaacacaagcaggatgccggctataaaggttcagaagataccggtcagacgcatattgatcagatccgcgatttccgtcagggcggatatgtgacgctggaaggttacatcgtgaacaaagagcagggcgaacggtatcagttccgtgacaataccggcaccttaccgattatcgcgccgaagaagacctttgatggtaaaacctacaccgcagaagataaagtacgcgtcagtggtaaggtacagggcaaaggggataaaaccacgctgcatgtgacccaaatcgaagagccgtaacaaaccgggcgaggaaatcttctcgcccgttttatttagtccttcagcagaatcgcccggcaggttttgcctttgattttgccctgcttgagtttcaccagcgcatttttggcctgattcgcctcaatcgccacataggcatgggtcggcgtcaggacaattttgccgatctgctcggcacgataacccgcttcacccgtcagcgcgcccagaatatctcccggacgtatcttggctttacggccaccatcaatgcacaaagtcatcatagctgcaggcagcggcttgctgctgccctttttcagcgtactggcagagacccacggcagcttctgctgcaggaaatcttccagcgcatgcgcgcgagccatctcatcggcagcaaccaggctgaccgcgacgccatgtttcgcccgcacgcgccgtacgaccaatacggtgcaggtgaatttcagggtcccaggcgagctgatagttaaccaccatcgccagcgatttgatgtcgagtccgcgtgcagcgacgtcggtggcgaccagcacgcgaccactaccgttagcgaagcggatcaacacgcgttcgcgatcgcgctgctccagatcgccatgcaaaggcagggcgctgatatcacgcgcgttaagcgccgcggcgacatcatcacattcacgtttggtgttgcagaagaccacacaggatgagggctggcgatcgctgagcagggctatcagcagacccagtttttcattgtggctggcttcgaaaaactgctgatcgattgaaggcagttcgctgacatcttctgtcaccacgctcagtgcatcacgctgaaagcgggtgctgatagccgtaatgccgtctggccaggtggcggaaaagagcagcgtctggcgcgaagcgggcgtcgcttcaatgatcgtttccatatcattcaggaaacccatctccagcatccgatcggcttcatccaggaccagcgtgctgagctggtccagcttgaggttttcgcggttaatgtggtcgaggatacgacccggcgtgccgaccacgatatggggcggatgcaccagcgaatcacgctgtgcgctcatcggctgtccgccacacagagtgagaactttgatgttgcgggtgaagcgcgccagctggcgcagcacattgcctacctgatccgccagttcacgggtcggacagagaatgagtgcctgggtctgaaagcgggcgctgtcgatatggtgcagtaaaccaataccaaaggcagccgttttaccgctgccggttttcgcctgcgcgcgcacgtcgcgtccctgcagaatggcgggcagcgtagcggcctgcacgggcgtcatgctggtgtagcccatctcgcgcaggttttcgagctggctgtcgggaagcgaattgagggtagaaaaagcggtcacgggcgcggcctctgaggctgaaagtgtagggcattattgcggggcaagtctggcagaaagcacgcctgacagcaacgggaacctcgatggttagcagtatgaaactatatctgtcagagggcttaggaatagactgaagtttacgggaaaaaggtggtttatttttatagattaaccccgacttaatgtgattgttccagaatgacgatcttttgaggccagcgattatttgataagtagccgtttttaaatatttatttcattgttaatcagataaatccttaactactactccagtaatagaattaatcattaaaaaatatcaccactagtgccgataaaaatcctgagctaattgctttatatttagcgcgccatattcctggtacaacgaccggtagagggtatttgcattgagtaatcgcatccagggaccacatgaaaatgtgcttaaaatagtaggccgcgccgtactgacactgcatgttcatggagagagcttatcggctgataagatcgcttcgatgattgcgtgttatgcggaagatgagccctgtgatcaggaagatcgtcgcttatacgcgctggcaatggaactaatgtcgaatgataaatgggccaaaagcgcgtaacccgcactccgctcaggtaaatgcagagcctcccttgtggaggctctgttgtttttggggggagtgggtttgcgttgtggggcaggtactggctcccggcgctttaggtaaggtggtcgtctgtaaccgtgcctgagccggctcgatctctccgcatttgctgagaaggctcagcgcgggcgattacgcacctcgtccctgaggtgcgcccgtagccgggccaacgctttgcgttgttcaaaaacgctcccggcgtttttagtacgcacctcatccctgaggtgcgcccgtagccgggccaacgcgttgcgttgttcaaaaacgctcccggcgtttttgtccgcagccctgctgtttcaggctgatgccagcgcaaacaccggtttaccgcgcgagaaggtcgcgacgaccggcgaaatccgtgccacggcttcggcggaacagctcgccgctaccagcatcatgctcgcttcatcgcccggtactggccactggcggtcaccctgggctgtcagcggcagccgatcgtctgtggcgatcgccagcgcccgcgacagcgagaaactcatccgatccccgatagagctgcgcatagagattcgctttttccagcatgctcccggtgccaaacggtgaccagtgatcgataacgctgtcggtgccggtcatcaccttcacgcccgctgcctgtaattgcggaattggcatggtcagcttgccgatcggcagcgtagaggcgacgctgaattgctgctccgccagcccttcgatcatcttatccagcgtactgccggtcagggtcgccagcgcaaaaccgtggctcagcgtcactttgcccttcagcgccggattctttgccacggtgtcaatcatgtactgaatcgccgccacgccagcgggtgaggtttcatgcagatgtatatccacgccgcgctgatagtcgagcgcaatctggaacatcgcatccagtgacttctccatggcaccatcgacattggtggggtccaggccgccgacatactcaacgccgtgctgcatcgcctcgcgcatcagcccatcgacctgcgagtgcagcaggccatgttggggaaaggccacaatctcgcagggaaaggcggggtgacgggctaatgccgcctgcagatgctccagactttgcaggccgctgaccgaatcgatattgcaatggctgcgggcgcgggtggtgcctttggcgtgcagcagagcgatcaacccttcggcgcgcgcctgagagtgcggcagcagttgcggaatcagcacctgttcacgcgcaatcatgtccatgatagttttgccctgacggggacgcggagcctgccacgggccgccgtagaaggttttatcaaggtggatatgcatatcctgggtggcgggcagcagcagggcatcctgtgcatcccacgacggcagggtgctgtccccctgacccgcgggtgtcagctggtcaattttaccgtcgcgcacgctgatgtcgtaacgcccggtgcgggtcgcaacgatctcatcatcctcacggataaagccctcctccagccgcacattgcgcagcagatagtgatcctgccggggcagggcggcgggctggtcgggattgatggaggacaaaggtgatggcgtggcggcactggcatggccgagaccggcggccagcaagccgcctgcggcggtccagcggacgccctgcccaaggaaatcacgacggctcggcgaagaggaaataggcatcagagactcctgcaaagtgaacaaggtcttaatctgacaaacgacgctccaccctgctgcgttattttccactgacgactattcgatatctcactgccagcgcagctggctgaaggttgccagggattccgccagctcgcgctgcagcggatcctgcggatgacgacagaacagcgccagttcgaaggtatcaatcaccggcagaccctgttccgggcccagtacccgatgttgcggcaggcggcagctggcgggcagtaatgtcagccccagaccctgcgcactggcggcggccagcgcgaccaggctggcgctgctgtaactaatgcgccagctacggcccagtgcgtcgagcgtctgacacacctcatcgcgatagagcccctgctggggaaacagcaccagcggtaccggcgtctgctcaaagcagggccactctgcgctatcgagccacagcaggggttcaggacgcgacgccagcggacgctcgccagcgggctgtttaatcagcatgatgtcgagctcttcacgctgccaggcgcgccgcagctccacctgcatgccgctcatcacgtccagccgaagttgcggatggtcgcgactgaagtgcgccagcaaaccggccgtgggcgcggcgaaatcttccggcacgccaagacgcagcacaccgtcgcgccactggtcactcagcacatcgtgcgcttccccattcagggcgataatccgccgggcgtagcctaaaagtttctcgccctcttcggtgatctgcacctgatgcgaagaacggttcagcagctctttgccgaccatctcctccagccgtcgcacctgctggctgacggtggactgcgacaggtgcacccggtcggcggcgcgggtaaagctggcggtttcgcacaccgcgacaaagcttagcagctgttgcggagtaaacatcggctgacgattcatatttccactacctggcagagtaatatttcatttccagatagtaacgactgctgccaggctggcaacttttaactgtgtggatctcagatgaagagagagaacaacctgctgctggcggcgctggtgttagccgggctcaatatgcgaccgctgatgacctcggtcagtccgttactcggcgagctgcggcagagcatcggtctgtcgccgctggcggcatcgctgttgcctgcggtgccgatgatgatgatgggtgccattgcgttagtcagcgccccgctgatgcagcgctttgcggtacgtaaactgctgctgggtggcctgttgctgttgctgctggcgctggtgagtcggctgtttgtggctgacggaggctggctggtactgagtactgtgccgggaggggcgggcattggcattgtgcagatggcgatgccgggattgatccgtcagcgatttggcagccgcagtgccggcgtgaccggactgtgggcagcggcgctgatgggcggcggcgggattggcgcggcgatctcgccgtggctgaatgggcagcttggctggcagggcgcgctgagcagctgggcgctgccggtggtgctggccatcctgctctggctgtttatcaccaccccacgtgcagcccggacggaggccgccgctctgccttcgctgtggcgtaaaacccgcgcctggacgctggcgttgagcttcggtctggtgaacggcggatatgccatctgtgtcgcctggctgcccgatttttatcatcaactcggctggagcgcgcaggcgggcggttcactgcttggcatgatgatcggctgtcaggtcacgggtgcgctgctgctgcccttgctggcgcggggccgcgatcgccgtccgctgctgctgctgacactggcgatgcagttcagcggcatgctcggtttcctgtttgcgccacaactggcaccgtggctctgggcggggattgcgggcttcgggctgggcggggcatttccgctggctctggtgctggcgctggatcatctggagcagccgcaggctggcgcgcggctggtggcttttatgcagggcgtcggctttattatcgcgggcagcatgccgtttatcgccgggcagttgcatgcgctcaccggtcacttcaccagcgtctggttattgcaggcggcggtcacgctgctgttaatcgtgctaaatctgcgtttccatccgcgcagctatcagcacgcctttccggaggtgaatcgctgattttggtccgaccaataccggcaatatttttctctggttcacactccgggaaaattcgcgcatcttctgttgccataggttaacaatgcgttaactatctgttgccataagccccgacagagcggtttggtctgaccaatccggggcagatggcaccagcgctgcggctgcgtgccacgtcaccttttcctctggagatactggcatgcagatctggcaacaaaactacgatccgcagggtaatatctggctttcaagcctgatcgcactgatcccgattctctttttcttctttgcgctgattaagctgaagatgaaaggctacctggcggccaccaccaccgtggtgctggcgctgctggtggcgctgtttctctatcagatgccggttgcacaggcgctggccgccgtggtgtatggctttctctatgggttgtggccgattgcctggattattgtcgccgcggtgttcgtctacaagatctcagtcaaaaccggccagttcgacattatccgcgcctctatcctgtcgattactcccgatcagcgtctgcagatgctgattgtcggcttctcgttcggggcgtttctggagggggctgcgggctttggtgcgccggtggcgattaccgccgcgctgctggtgggactcggctttaatccgctctacgccgccgggctctgcctgattgtgaacaccgcgccggtggcctttggcgcgatgggcatcccgattattgtggcggggcaggtgaccgggctggacagttttgccatcggccagatggccggacgccagctgccgctgctgaccctgattgtgctgttctggattatggcgatcatggatggctggcgcggagtgaaagagacctggccggcggtggtcgtggcagggggatcgtttgccattgcccagttcctcagctccaacttcctgggtccggagctgcccgatattatctcgtcgctcgcctcgctgatttcgctgacgctgttcctgcgggtctggaagccggttcgcatcttccgctttgccgatgcagaggcgaaacagggcgatccgttgctgccaccgcagaagtatcggctggggcaggtgatccgcgcctggatgccgttcctgtttctcaccgccaccgtcacgctctggagtatcccgccgtttaaagcgctgttcgccaaaggcggcgcgctctatgagtgggtgctggctatgccggtgccgatgctgaatgagctggtggcgcggatgccgcccgtggtcggcactgcaaccccttatccggccatctttaagctggatctggtgtccgccaccggcaccgccattttaattgcggcgatcatggcgatgattttcctgcgcatgaagccaaaggcagcattgcagacttttggtgaaacgctgaaagagctggcgctgccgatctactctatcgggatggtactggcctttgcctttatctcgaattactccgggctgtctgcgacgctggcactggcgctggcgcacaccggccacgcttttaccttcttctcaccgtttcctgggctggctgggcgtcttcctgaccggatcagacacctcatcgaatgcgctgtttgctgctttacaggccacgaccgcgcagcagattggcgtctccgatattctgctggtggcggccaacaccaccggtggcgtgaccggtaagatgatctcgccgcagtcgatcgctatcgcctgtgcggcggtcgggctggtgggtaaagagtccgacctgttccggtttaccgttaaacacagcctgattttcacctgtatggtcggtgtgataaccacacttcaggcctacgtcttcccctggatgatcccatgagcagcaatgccgatccgctggtgacgcgcctgcgggcctatatcaccgaacatcagctcgagccgggcatgcgcctgcccgccgagcggcagctctctgcggagcttggcgtctcgcgctcctcgctgcgtgaagccatacaacagttgatcagcaacggcatgctgattagccgacgcggcggcggcacctggatccgtcagcagctggcgccctggtcggaacagcgcatcgtcgagccgattcgccagctactgcgcgacgatcccgactaccgctacgacattctggaagcgcgccatgccatcgaggccagcaccgcctggcacgccgcactgcgcgccaccgacgccgacaaagagaagctgcagtacgctttcgacgccaccctgaagctgaaagagagtgacgatcccgatctcgccgcccaggctgatgtgcgcttccatctggcgattgccgaggcgtcgcacaacgtagtgctgctgcagaccatgcgtggtttttttgagctgctgcaatcatcggtaatgcagagccgtcagcgcatgtatacccagcccgcgattttcgcccgcctgactgaacagcatcaggcgctgctcgatgcgatcctcactggcgatgccgacgctgcgcgccaggcggcgatgcagcatctgggattcgtgcacaccaccatgaaaagcctgcatgaagatgaagcgcgtcaggcgcgcatcacccgcttaccggataacgacacacgcaacccaaaggaatctgactgatgattatctccgctgccagtgactatcgcgcggccgcgcaacgtatcctgccgccgttcctgtttcactatcttgatggcggtgcctatgccgagcacaccctgcgtcgcaacgtagaggatctctcggatgtggcgctgcgccagcgcattctgaaaaatatgtcggaactgagtcttgaaaccaaactgttcaatgaaaccctgtcgatgccggttgcgctggcaccggtcggcctgtgcggcatgtatgcccgccggggtgaagtgcaggcggcgcgtgcggcagacctgaaaggcattccgtttaccctgtcgaccgtctcggtctgcccgattgaagaggtggccccgcagattaagcgtcccatgtggttccagctctatgtgctgcgtgaccgcggctttatgcgcaatgcgctggagcgcgccaaagccgccggttgctccacgctggtgtttaccgtggatatgcccacgccgggcgcgcgctatcgcgatgcgcactccgggatgagcggcaatcacgcggcgctgcgtcgttactggcaggcggtcacccatccacagtgggcgctgaatgtgggtctgcaggggcgccctcacgatctggggaatatctccacgtatctgggcaagcctaccgggctggaagattacatcggctggctggcgaataatttcgatccctctatctcgtggcgcgatctggagtggatccgcgaattctgggatgggccgatggtgatcaagggcattctcgatccggaagatgcgcgtgatgcggtgcgctttggcgccgatggcatcgtggtctctaatcacggcggacgccagctggatggcgtgctctcctcggcgcgtgcgctaccggccattgccgatgcggtaaaaggtgacatcgccattctggcggacagtggcattcgcaatgggctggatgtggtgcggatgattgcgctgggcgcagacagcgtgctgctgggacgggcatttatctatgcgctggcaacccacggtcagcgcggcgtagaaaacctgctgacgctgattgaaaaagagatgcgcgttgccatgaccctcaccggcgcgaagtcgatcggtgaaattacccgcgattcgctggtgcaggcggaagcgttactggcaccacagagcacaccgccacgtccccgcgcggtgagttgagcctgcgaaaatgaatgtattgtctatacttagcttctttaccaacaggaggaacgacatgaccattcataagaaaggttcggcgcattgggaaggcgatatcaaaggcaaaggcaccgtcagcaccgagagcggcgtgctgagccagcagccttatggctttaacacccgttttgaaggcgccaaaggcaccaacccggaagaaactgattggtgcagcgcatgcagcctgtttctctatggcgctgtcgctgatgctgggcaacgcgggtcatccaccggaaagcattgataccacggccgacgtgtcgctggataaaaaaggcgatggctttgccatcaccaaagtggcactgaccagcaccatctctctgccaggcattgatgagtcgaccttcgacgagatcatcaataaagccaaagcgggctgcccggtttctcaggtactgaatgcggaaattacgctggattacaccctgaacaactgatgccggtaacgggtcgccttttggcggcccgggcgttatgctatgcctcaccggtcctgttgctgaccggaacagatgcgccttctggcgcatcttcgctttctgaccagaggaaactgaggtgacgagataccgggcagccaaaaagtactggaagatggtgctggttctgttgtgcatctgtggcgcgctgctgctgattcgctgggctgccatgatctgggcctgaacagatgaaggggattggccgccacacgctgggcatattattaatggtgattattgtgctggaagcggttcactatctgcttactgcctcatggctgccgtggcgataaacgcgctcagacaaaggcatcctcgcgccttttagaccgcacatcgctgcgcgcaatgcgataagccttgcgcggatcgcctaccacaaactcaaaggttggcgtgtagtaaaatggcagccagccgccatagctgctctcccactcccaacggacggggcagggccacagaatgccatcatacaaaagatagtaaacccagcgtccaccaggacgacgggggcgtgatgttttcatgggattcacaacgataatggttaacaacagcttatattttgtacgctaaagcgtcagcttgcaacgttacagccctgctttattgaacctggccctgaattagcgatgtacttcgccgcacagcagtaccacattcggtctgactttatgaatgcggttcgccatcgtttcacagtcgaccttcgtcggatagatgcgctctgataccggcagcgcctcgcaggcatcgtagccgcatgcgctcactaacaacacaaatcctatcaacatagatcctctcctttacacggtctggtggtccggactgtggtgctttttatccctttttaacatccagtatagacaaacgtgccggggcggcattgtcagtgtgagctatggtccgccagccagggtgtgatgcggcggcctgtaaggtgtgtcagaaggggcgggcctggcgctagcctgcgaaataccaggcgggcagcagcgcaatcaggttattcagcgtgtgcaggaagatgggcagcgccagactgttactccgcagccgggcgtaacagagcagtagcgaaaacagcgtcagggcgataagggtctgccagtgcacatactgcgtatgcatcaccgcaaacagcagtgaggtcagcagcatacaggcaaagcggctccgtggcgcccacagcagaaagccctgcaacagaaaaccgcggaacagcacctcttcaaacaccggtgcgagcagcacggcggtgagcagcaggatcagcagcgaattacgtccctgctgggcctgcatcaccagccatccttccggctgcatgaactgcatctgtgcggccatcagaacaaatagcgcgccagtaaacagcagagtttgcagggtgcagagttcacccagcggcaggtctgtacggcgctggcagtaaaagcggtaaagcggatagataacagcaaattcaaacaggcagagcaccggcaccagcaggccgtcattacgcagcacgctgtaattagggaacagcgtgatcagcatagtaaccaggtaatagaccacaaagctgccgacgtagaacagcgtcagtgtcactctgtcggaattggtattcataggcgactctgccagcgaaggttagcgcatagtagcaatgcaccagatcgctgtcgagtcagcctgtaacacaatatttaagcgcaaaatgttaaccgcagactaaacacccgcgcgcgtgagccgataactgaggaaactaatctggtcagcactgcatgttgtattgcaggcccgtcatctcaaactctgactgtgtagtgagcactcttaatgacttctaaccctccggcgccaccctcgcctccattcagtcatgccgctgaagaccgcactgtccgctttacgcggcgcagcctgcgcacgctttcgctgctgctgtttggcgtgctggtgctctcgatgctgatggtgctgacgattgcgcagcggcaaaacagcgtatcggttgagcatgaccagttgctgatgcagcaggcgtggaaaaatcgtcaggaggcgatggtcacggatatccgggattatgcgttctggggcgaagcctggcgcaatctccatgtcagggtcaacaaagtctgggcttatgacgaagagaaactttggtccgggcctctacgaagagtatcactatgagggcgtattcgtggtcgacggcaacggtcacaccacgtacagcgtcattaatgggcaactggtggatacgccgctggaagcctggctgggaaaagaggctccagcgctgattgcggcggcacgtcagcgcaacgacgcggcgataacccgtgatgcgctgattaatcatctgcccgccattgtggttgccgcccccatcggcagcggcaaactgacgaatatgccgccgatagcggggccagcgtcagtcatggtgtttgtgaatctgttcacccctgccaaattacaggcgctgggcgccacgctggatgtgcgcgaactgcgcctgcccgtcagtgcaggggatgccctgcgtgaaccgcggatggtgcaaccgttacccggtggcgatctgattgtgctgcgctggacgccaaagatgcctggcatgggcctggtctggtttctgttaccactactgatgctcatggcgatcatcattggcataatcacccatcgcgtcagccgccatgcgctctctaatgcgattctttctgaccggcgctttgccctgctggcgatcagtcagcaggagctggccaacagtgaagcgcggtttcgcgatctcgctgaggcggcgtcagactggatctgggaaacggatggagagggccgcctgatctacctgtcagcgcgctttcaaaccgtgaccggccacgatattacacactggctgggccgtcacatcgatcacctgctgacgcatcccagccattcgctggtcgcctggctgcagcgtcaggaggaggaggggcaacggatgccactgcgctgtcagtttatgtcggcgcacggcaaccgccgtatcggccagctggtcgcgaaaacaatctggcatgatgcgcgacgtatcgggtttcgcggcacggtgtcggacatcactcagagcatggaagccgaggcgcgcattcattttttgtcgcgtcatgacgtcttaaccggcctgtcgaaccgcgtacagctgcaggagtttctgacgctacaccttgagctgcctgatggcgctgcgccgctgacgctgattaccctcgatctcgatcagttcaggccgattaatgaaacctggggccatgcggcgggcgatgaggtgctgagccagatagcgcagcgtctgaagcgctgtatcggcccgcaggagctggtggcgcggctgagtggcgatgagtttgtgctggtattgcgtgaaacgaaccgtgagcgggtcgatcagcgttgcgcacagctggtgcacgaggttcagcagcccatcagcaccggccagcatgtccactatctcaccgtcagcatggggattgcctgtgtaccgcaggatgccagccatccggaagcgctgctgcaaatggctgatatcgcgctgaatgaagcgcgcgaagcgggacgcaatcagtgggtctggtatgccaatgagatggccagtcagcgtgaggataagcgtgaaatggcgcggcggattgagaaagcgctgaagaacaatgaatttcgcctgcactaccagccccgctatcaactgctgacggggcagctggcaggtgccgaggcgctgattcgctggcagattgcgccggatgagtggattacccccgatcactttattccgctggcggaagagagcggtctcatcgccaccatcagcgactgggtgctgatgcgcgcatgtgaggatgcgctgggatgggggggcgatcgctatgtttcggttaatatttcgcccatggagttccgcaccagcgatttagtgcagcgggttgcagatgtgctggctaaaagtggcctgccggctacccggctggagctggagatcacggagaaacgtgacctttgaacatccgcagcatgcgctggaggtgatgcagggtttacggtcgctcggggtaaggttaaccgttgatgatttcggcaccggctatgcggccctgggctacctgaagaccttcccgtttaatgggctgaagatcgatcgctcctggatgaaagatttcccggagtcgcagcaggcacaatcggtggtcgcggggattattgcgctggcacgcgcctttgccctgacaattacggctgaagggattgagacagaagcgcagctgaatcagcttaaacagctttcgtgcgaagaggggcaaggctacttcctcggtcgaccgatgccgctggctgcattcagtacgcttctggaaagaaccgcgcagaaccaggctgaacccgtttaacggactttaaccgccacggcggtcatcagcattgcgcagacgacaaaaataatcagttccatcatgacctccacagggctaagactattcttaatattgtagtggtccgctgtgctttttttaggcaatgagtgcgattaatcttaaaagatgacctgtgcggcgacccgtttaatgctgctgtaacaactttactttttaggggttcaggtcagcaggtgcgctttgctactcttggggcagggttttacacgtccaacaggagaataaacgtgaaattttatggaaaagggctgctggtagtcgggctgtttgcattaaccgcctgtcaatctgcctctaagcccgataccgccagtgtggcgcaggatcccgaagctgaccgctgtggtgcctctcagtttcagaattatgtcggtaaaccgttaaccgcgctgcagggtcagcacttcgaacagaaggtccgcgccattccctataattctgccgtcaccatggacttcaaccttaaccggctgaacttcctggctgacaaaaatggcaatatcagctcagtttattgtggttaatggcaaagatgtcataggtttgtcataacggcaggcgaggatagcagcgcgtttaagaaacttcctcgtcacacaatagatagtgctcgtcttgtttattcccgccccggcgggaatttttttagcggcttcgggccgtaacaggagcagagaagatgaaacgcataatcggggcacttctgcccgcattgttactcagcagcacactggcgcaggcttccagtgaagaggcctggcaaaagagccgtcaggtgatggtgcaggcctgcattaacgccagtcatctgagcaaagtaaaggtgctgggcgaggcgatcgagtatgacgacaatacgggctacagcgcactgttgctggagggacgttatccccagccgcagatgaaaaataagcgtggacgggagctgtgcctgtttcagcgcagcagcggacgagccagtatcagcgaagcggataaattgcgctgggtgaagtaggtggtgggtttacgcctccggctgcgtgtcgatcaactgcgccagcagggtgcgataacgctgcaactgcgtctcgtcgccttccacttccagtttatcgataacccgcgcaataagggctttattggtggcgggttttctcccgcttccattatttcacgcagaatcaccgccagcagatcggactcaggcggtatccgccagtccgggctgttaaaatagtcgctgatagcacggctggcgctgtcaggttgtactctcattacccacctccgctaaaacaagaccccctcccttacacctgagcataagggcgtttaaccatgaaataagctggttcgcctcagcgtagccggacggtctgcaccgttttttgcggaggatgtcgcgccgattaaaaagattgctataccgccgcggctggcggttttttaaacatagaagcggggtgaagagttgtcagtaacagaatgacatatttttctatattgacgggccggattgagggatatcgggtctggccagaccatcgcccgcgtgcttcgcgctaaaaacccggtgggctggaaaatttgcgccggtgattgcgctgaatcaaagaggaaaccggtcttttgccatttgtgccatgttttgtcggtcacgctgagaatagccgcgttagactgaacattccctctctttaaaatatctgctcatgccacgcactatagaaccctggaagataaacctgatctcggtctggtttggctgtttttttaccggcctggccatcagccagattatcccgtttctgccgctctaccttgagcagcttggcataaccggtggcgaatcactgagcctctggtcgggtctaaccttcagtatcacctttgtggtttcggcggccgtagccccgctgtggggcagtcttgccgatcgtaaaggccgtaagctgatgctgctgcgcgccgcttttggcatgggcgtggtaattctgctacaggcttttgtcaccgaagcctggcagttgctgctgctgcgtgccctgatggggctgacctccggatatattcccaacgccatggcgctggtggccgctcaggtgccgcgtgaacgcagcggctgggcgctgagctgtgtctcaaccggtcagattggcggggtgattctggggccgatgctgggcgggctgctggcagactgggtcggtttgcgtacggtgtttattgtcaccgcagcgctgctgatggtcagctttctggtgacgctgttcctgatcaaggagaccggttacaccccggtgagtaaaaaggagaagctcagcggacgcgaggttttccgctcgctggataatccaaaactgatgctctgcctctttttcaccaccatggtgatccagatgtgcaacggatcggtgaaccctatcctgacgctctttgtgcgggaactggcacccaccgctgagaatatcgcttttcttagcggggtcattgccgcgctgcctggcgtctctgcactgctggccgcgcctcgtctgggacgactcggcgatcgcatcggtacgcagcgtatcctgctggcaacgatggtcatctcgctgctgctgtttatcgccatgtcgtttgtcaccagcacgacacagctgggggtattacgttttctgctgggctttgccgatggcgcgatgatgcccgcggtgcaggcgctgctggtgcgtcactcgcgtgacaacatcaccggccggatcttcggctataaccagtcctttatgtatctcggcaatgtcgcgggtccgctgctgggcgccgcggtgtcggcggtggccggtttccgctgggtcttttttgccaccgccgtggtcgtgctgattaacgtgctgtttctgaagcgcttttaccggcgtccgaagacagatctgcccgcgtcggctggcaaatcgtcagttcagcctgccagcgctgctgagtcagtaaaaactcaggactgacgctggggctccaggagtcatcgccgccgacacccatgtggcaggcatccagatgcagccagcagcccgcttccggacgcagatggtggcggtgtgatgcctcccgcaactgctccaggctaaaacggctcagtgagaaagcgaaatcgccgctgacctgccagctgccgctgtcgagctgacgggtgccgcagcgcagaccgttctcacccgggaaaacataaggcgttgagagctgatccagcggcagctcccagcgggaaaactgcgcggccagctggcgatcgggatagttttcatgcggacccagcccgagccagctcacctgttgtggtatctgcgtcagctcacagcgtaatccgatgcgcgcgggcgggggcaatccgcgcgactgctcaacggaaagctgcaactgcaattcaccctgcgcattgatcagataacgtttacggctgataaaggcgatctggccatgggcgagccagctgtgcagcgtctcaatctgcaccgcctgtggcaacgcattcgccgtcatcgacaccagctggctgctcatctggtcataacccgctgctttccagcgctcgacccaggcattgggatcaacccgttccgcttcgctggtgccgatgtcattgtcgagcggggcgcgaataaagcagtcctgaagcggtgaaagcagcgtgggctgttcatccacaaaccactgcgtcagttcgccgctgtggcgtgaaaaatgccagcgttgctgctgatgggtgatgacaatctcacgggtatcatcgtgcaggcccggtgcgtggccgctctccggctttgatggcagcgccagcgacgagggcagcgcccattggtgccaggcgacacgccagtcagcggcgctccattgggtcggttgaatctgatgaaccgcgacgttcagccagcattcgccctgtaatgctggcggtgacggcagcgtgatccgctgctggccctgtggagcgatatccagcggcacttctccttccgtcaccacacgacccgcctgttcgatgcgccagcgcagcacttcgttgtcactgtggcggaacaaatagtcgctgctgaccgtaaagctcagcggatcgccgggatcgacgtcaaactgccagaactgctgggcgcactgcgcctcataaagcgccggatgcggcgtgcgatcggcaaataccagcccgttcatacagaactgacgatcgttgggtttatcgccaaaatcgccgccgtaggcctgccagggttcgccctgatcgttatagcgggtcaggctctgatcaacccagtcccagacgaagccgccctgcagacgcgggaaactggcggaaggcctgccagtacttagcaaaaccgccaaagctgttgcccatggcatgcgcgtactcacacaggatgagcggacgcgtctcacccggcagaccgatccactttttcagcgaccatttcggcaccgccgggaagggctgatcttcatcaaccctggcatacatcgggcagatgatatcggtagcagcggtatccgcaccgccgccttcatactgaaccggacgggttggatcgctgctttttacccaacggtagagcgcatcgtgtgtggcaccatgtcctgactcgttgcccagcgaccagataataatgctgcagtgattacgatcgcgctgcaccatgcgcgtcacgcgttcgctataggcggcgaaccagcggggatcatcggagagccggttcatcggctgcatgccgtgggtttcgatattggcctcatccaccacataaagcccatactgatcgcacaaccggtaccagagcggatgattaggatagtgtgaacagcgcaccgcattaaaattgtgctgcttcatcagctcgatatcgcggcgcatcgtcgcctcatccaccacctgaccgcgctccggatgatgttcatgacggttggtgccacggatcagcagcggtttgccgttcaggcagagcaggccgttatcgatggtgacctgacggaagccgacatcataggcttccacctcgatcagctgctgattctcatccagcagcgccagcgtggcgcgatagaggtggggtgtttcggcactccacagcgcaggctgttccaccggcaggctgagcagggcgcgttcgggatagtgaccccgctcgtcaataatggcactgcccagcggctgctgacactgagcaatctgctggtcaccctgccacagcgtcaggcgcagcttatagcgcgagctgacgtcatctggcagagcaacacggacccgggcacgcaattcggcacggtaaaactccgggctgagccgggtttccagctgaacatcggccagatgcacctgcggtttatgcaataacgtgacgtcacggaaaatgccgctcatccgccacatatcctgatcttccagataactgccgtcgctccagcgcagcaccatcactgccagccggtttttgcccggccgcagataaggcgtcaggtcgaattcagcgggcagacgactgtcctgagagtagccaatccagtgtccgttgcaccacaggtgaaaggccgagtttacgccgtcaaaaatgatgcgtgtctgcccattatccagccaggctgcgtcagcactgaatgtgagcgagtaacatccggttggattctctgcggggacaagtggaggagtaaccggaatcggatactgcacgttggtataaatgggcgcatcgaagccgtgcatctgccagttggccggaaccggaagggtcgtagtgtccggcagatcctgcagtaaccagctggccggaaccgcttcaggctgcgtaaaataacggaaaccccactctccgttgaggctctgcagtgacgccgaggggctgtcatcccgcgcggctgcttcatctcgccagctggcgaatggcgggtgcgcatccagccgatgcagcgaggtcacgaccggattttcccagtcgcgccgggagaggatgtcactgaaagcagcctgagagagagtcatgtttatatcctgtaaatgtaatgcgctcacaatgcgcaaaattacgccgcctgtaaagtgttcaccctcccgatttgcacaaataatttgcgctgtaatccagccgggatgttgagattgtgccgccttaatggtggtaaatcgttaagtctggtcagcaaagatgaatagtcgccggatgcggaagaatctcacttgtcgccatgcaggtggctccatacactcagcccgatttcatcaccctgaggtagatatggtacgaatctttaagctggctgccgttgtggcattggttactgcattaagcggatgtattttcccgcctccaggcggcggtgggggtggctggggcggacacggcggcggaccaggccgcggatttgtcgatcctcgctaagcaaaagaccgatttcggacgggcgaaacgtttaaccatagcgttgattgcagggaaaacgtttcgctcgcaaggttagccggcatcgtctgagcagacggtgaggaatgcgggctaactcactgaaaaaagtagcggttaccctctgtttttttagccagcgtggtgataatttcagcttttctccaccgctgagataacagcatgaaaaacctgattgctgagttgctggtaaagctggctgaaaaagaggcgacagccaaagagcagatggcgcaaatcgaagcgctggagattgttgttaccgcgctggtttcgcaagctggagccgcaacaacatctggctataaccaccagtattgaaaccgcaatagacaatgtggccgatgccgaagatgaaaatgcgcaactgctgcgcaattacatcgaaaagttactccgccatcctcgtcagtaacaatcccagtgccagactggaatgggatcttcacatcactttgacctgaaacattttccgctttgcttattcgctgccagaataacaaaggacaatccactgtggagataacaagatgaaagtcggtttaatggcgatgatgatggcgggcctgctggtcagtggactggccggtgcggcggagaagaccccgcagcaggagaagatgacgatgtgtaaccagcatgctaaatcacaggatcttaaaggggatgcgcgcaaaacctttatgagtgaatgcctgaaaaaggacagcaagctgtcgcagatgtcaccgcagcagatgaaaatgaaaagctgtaacggcgaagctggtgataaaaaactggcgggcgatgcgcgtaaaacctttatgagccagtgcctgaaaaaaagctgattatccccacggccacgcaggtggccgcttctccttcccgcgcaatgctgattaaattcccttctataacagcatgttaaccttctgataagcattcatcgccaggcttcccggttcttttgccacacttactgtttgtggggatttgcgcagcactctgttttgccgcgcagcacaagacaagaaccgttaaaggagccatgtcgtgaactatcaatttaccgtcgacctgaacgatctgccccagcgccagccggttaaaaaaacgctcggcgaggtggaagtgttgctgatccgcgaaggcgaccatgtacgtgcttatcaggcgaaatgcccgcacgcaggcgcgccgctggagcagggcgcgatttgcggcgatcggctggtctgtccgtggcacaaagccgcgtttaatctggccagcggaaaaatgtgtgaaccgctggcgttagccgatctcaaacagtatccgctgcgcattgaagagggccgggtgctggtgaatccgaaagcgatgtcgcccgcggcgccgattggcagtggggcagaagcaccggtctatgtggtgctcggtggtggggcagcgggcagcgcggcgctgtggcgtctgcgccatgaaggcttcaaaggccgcgtgattctggttgagcgggaagcggatgcgccttacgaccgcaccgcgctgaccaaatttgtgccgtcgggcaaaatggatatcagcgaggtgccgcagctgctgaaagcggatgtgatggaccacgttgaacggcttcaggctaccgtgagccgcctggatgcccagcagcaacggctgatctttgaggatggcgagacgctcgccttcgacaaactgctgatcgccagcggcgcgacgccagtccgccccgatttgccgggcagcgatctcaatggggttcatctgctgcgcagcaaagcgcagaccgatgagctgcttcaggcggtggatgccagccataagatcgtgattatcggcaacagttttatcggcaccgaactggcgtcggcgctacgtaatcgtgacattgacgtgacgataatcgcccgacaggcgttgccctttgctaaacagtttggcgatcagattggccgctatttctatcagctgcatgagcagaacggcgtgaagtgggtgcagggcgagatcgaagccttacagggcgaccagcgggtgagtggcgtgcagctcaagggcggacggttgctggacgcgacggtggtgctgtttgccaccggggttaaaccggctaccgactttatccacgatctcccgctggcagaggatggcagcctgcaggcggatgagcagttgcgggtcgctgacaatatctgggtggcgggagatatcgccacgtatccgtcggcgcaggggccgctgcgcattgaacactatcgcgtcgcgcatcagcagggacaaaccgccgcatggaatatgctggaccagaccgtcgcgtttgatcgtgtgccgttcttctggactacgcagtatggcacccgttatgagtatctgggccatgccaaagaatgggattcattccagctgctcggctcgctggaggataaaaagtttatggcgttttatggccagcaggggaggctggcggcaatctgctcatgcggcatgtatacgctgaccgctgagctggtggagcggatgcagcagccgatgacgtttgccgacgcggtggcgctctgtcaggaacagatccgttaatatcagttaaggcggaggcaaggcgggccagcgtacggggccgccttgcgcaacaacactcactctgttagctgcggctcagtttctctgacttcgccatgcactgcagcatcgcttccatcaccgccgagcgcatgcctttctcttccagcactttcaccgcttcgatggtggtgccgcctggggagcagaccatatctttgagttcagccggatgttttccggtggtcagcaccatctgcgccgcccctttcaccgcctgagcagcaaactgataggcctgagcgcgtggcatgccacccagtacggccgcatcggccatcgcttcgataaacataaacacgtaggccggcgcagaaccgctgacgccgaccacggagtgaatcagatattcatccaccacggccgctttgccgaagctctcaaaaatcgctatcacctcgtcgatttccgcctgctcaaccagcacgttgggcgtgaccgaggtcatgccttcgctgaccagcgagggtgtattcggcatcgcacggacaattttacgatcgtaacccagcaccgatgagagcgaatcgagcgtcaccccagccgcaatcgacaccaccagcgcctcttttttcaggctgcctgtcagctcttttaagactttcagaatgacattgggtttgaccgcgccgaacaggatgtctacttcacgcgccagcgcttcagcgctctccgctgcgttaatgccatactgctctgccatcgcctggttggtctctgctttgcgatcgtaaacgaagatatcagacggggcgattttgccgctgttgaccagtccgccgataatggctttcgccatatttcccccgccgataaacccgattttctttgccagcatcgccatctccttaggacattattcgtttttctcagtgagctagcttacttcagccagcctgaataacaagtcagccgggcgcaggctggaaagcacgccgcaaataaaatttgccatttaaggggaacccggcaagatcttactcttctctgactgtaaggaatcatgatgtttatctgggtcgatgccgatgcctgtccgaatgtaatcaaagaggtgctctaccgcgcagccgaccgcaccgcaactaccatcacttttgtggcgaaccagtttctgcgtgtgccgccctcaccgtatctgcgcaccctgcaggtgcctgccggatttgatgtggcggacaatgagatcgtcagacgttgtcagcccggcgatctggtgatcaccgccgatatcccgctggcagcagaggtgattgagaagggtgcggcggcgctgaatccgcgcggcgagcgttactcaccggcgacgatacgtgaacgcctgacgatgcgggattttatggataccctgcggtcaagtggggtgcagaccggcggccccgcggcgatgagtccgcgtgaccgccagcagtttgcaaatgagcttgatagctggctcacccagcagaaacgctgaagttaaacgaagctgtcgtcgtcgtaatcgttgccgccaaaatcattgagatcgctgttgtcggcataattactgtcccagcctgtattctggtcgaggaaggcgttgtcgttaccgccgttaaaggtatcggcattgtcatcgccaccgttgaaggtgttgagattgtcattcacatcgggcagggggggctcattgataatgttcacaatctcttccggctgtgaatggtggaacatgctggtcagcatatcggccatcaccacaccgcccgccacacccacagctgtctgcagtgcgccgccgaggaaaccggtgccgcgtggtgcaggcgcttgtgcaggcgcatattgcggctgagccggttgctgtgccgcactgttccacggtgacgattgctgttgctgctgcacaggcggctgctgacgcgaaccgctgccaaacagcccggacagaaagccgccgctgctctgtgcaggttgctgctgctgttgctgggccagctggctttccagcgccgatactttctcattgagttttttcagcgccgcttcctgaatcaggatcgcctgtgccatgtagtaaggcgcgcccggctgcgcctgcagatgctggttaatcagttgttcggcagcggcatcgcgtgccacggtctggctttcagcctgtttcagacggctgaacagcccttcgatcagttgttgttcttcgcgttgcatgatgactctcctgtggcgattgttaccagtatatgtgggcgccagcgtgaaaagtaaaatcggggcagtaagcaaatattgccgacgcattttagccgctcttttgcggagtttttatcgctctgttacggccctgatgcacaaaacgtgcatgcatttccccttgaaaacacaaagattgtcgctgttcaggggacgaaaatgcgtaaatcgtgcctgacaggtagaggccataataatttccagttattatgcgtcgcattaataagctcaccatgcagccgcatcgcgcggtcaggcggaggaacggccctgatgtcactacccatctttttgattggcgctcgcggttgcggcaaaaccacggtcggcgaggcgttgtcgcgggcgctgggctacgcctttacggataccgatcaccatctgcaactcagcacgcagcggagcgtgacggagattgtggcggaggaaggctgggaaggtttccgcgcccgtgaaacggaatcgcttaaagcggtgacggcgcccggaaccgtcattgccaccggcggcggcatgattctggctgaagagaactgtcgttttatgcaggagcagggccaggtgatctggcttagcgcgtcccccgaggtgctggcagagcggctggaaagtgaacctgaagcggcccagcgtccgaccttaaccggccgtccgattgctgatgagatgagtgatgtgctgcgtgaacgtgcgcatctctatcaggctgcggcccatcatcaggtgaatgcgatgcaatcgcccgagtgcgtggtagaagaaattctgctgtcactctctctggcgcgcgccagctaaccctcagatttttcccgctttgatcccgcttcagacggcattgtctatacttatcctatgacaggcagcggcctgtcctgtggaatgttattcagacaagagggacacagtatgccgaccagaccaccgtatccacgtgaagcgaaagttgtgcctgttgaaaagggcactgaaggtaataaagtaacctcttacgaattgcgtgctgatcatcccaaaccgaattcattaatcagtgagcacgaaacggaagaagaagcgcgtgacgctaaagcgcgctacgaagacgttgaaaaagagtaaagcttcattgctggcagggacgccagcctgttacaccgcataactgcttattactgacccgcctgacgctgtgcctgaaccacgcctctttttactcccacctgaagtcgatcgggttatttaagaagcgaaattgacgcagatttactgtcgaatgctctctgcgtatgcttctgttctgcactctccttgtctcaccagataaagccccgctaatcatttttatccccttattttctctgctgccgatctctgtgtgagtcaaattgtcgcttgaccgattcagcgccacgttttattttcatcaaaccaacagaggaacttagttccatatagtggaacacgtaacatgaccacacttgaaaatgctgccgccgtacttcgattgtttcagcacaaaggtgtgacgcaggggcatgttggtctctcattcagtgaggtggttgaggcgttaaacctgccaaaaagcaccgtttcgcgtctgctggccaccatggaaagtcaggggctgctggagcggaatgcggatacgcgcggttatcacattggtcgcgtattgctggctgctgccggacattatctttcggcaccgctggttgacagcgtttcagcggcgatggtcaggctggctgcgaagaccggctgcatgggttacgtgtcgaagctcgacgggcgggaagtattagtgatgcgtatgtttcatgggcgtcactttacgcagatggtcacgccgccgggcagtcggatgccggctgccgcgacctcaaccggccgggcgctgttagcgcagttaagtgatgaagaggtgctggcgcgcttccatgatcaatggcaggtcgcatcagcgaactcgccgcaaagtcctgaggcactctgtgccagactggctgagatccgccagcagggctggtcactggcccgaaatgaatcgctgccaggcatcagctcgctgtcagttattgttcataacaaacatcatggcgaaacggtggcactctgcctgtcgtttccgtctatggagtctgaaccgggtttcccgtcagagctccttgaagcattacgcgcaacggccactgagatgaccgaaaaatatggcgcgtaacttcacaccgtttttatcggcgtagtactttcgccacaccagggaaaacaaaggccttcgggcctttttctttcaatctgatcgccacgttttacgcagcactccggttgcctgtgtctgtctctcattgcctcctgtatcggttcagcctccggagggacgaccatctgcagtggctgttgcaatctctgtgcgcatcagagcagtgaaactgataaccggcgtaaaccggccagcaggcgggtagacgttatttcatttcttctggacaaggactggcggggacatatggaacgggtaaatccgattaagcacgttggcgtggcactggttttaattcttctctccatcgcgggtgccattattggcattcagctgattaccaccattggcgtaacgcctaacacctctattatcggcgcgctgtttgccatgctgctggcgcgtattccgctgcaggcatttcgccgttatcgttcaattgaaatccagaaacctggcgcagaccgccatctcttcagccacctttggggcggcgaacagtctgttgatgccgattgccgtgccctgggcgctgggtgaaccgcaactggtcctgccgctgttctgtggcgtcagcgccgcgatgctgctggatgcctggctgctctatcggctgtttgatacccgcgtctttccggccagtaatgcctggccaccgggcgttgcggcagcagaagcgatcaaagcgggtgataaaggcggacgccaggcgtggctgctggtgctgggcatcgtgggtggcgtcgtcggtgccatgctgaagatcccgatgtccgccttcggcaccgcgtttatcggcaatatctgggcgctgtcgatgctcggcatcggttttctgctgcgtgcctatgcgcagccggtggccggtattgatattaatgcgctctatattccgcatggcgtgatggtcggtgccggtctggtagcgctgattcaggtcgtgatggtgattcgcagccgcaaaaatgatgcgctggtggtgagccgcaatggcaatgaggtgcagcgggcgctgggtttcggcagcgtgggttacatcgtgatttcggcgctgctggcgctggcgggcggcctgtggagtgagatgggcatcgcgatgctgctgctgtttgttctttatgccgcgtttgctgctttcgcccatgaactgattgtcggcattgccgctatgcactccggctggttcccggcctttgccgtggcgctgattacgctgattatcggcattctgatcggcttcccaccgctggcgctctgcctgctctgcggctttaccgccgccaccggtccggcgttcgccgatatgggttatgacctgaaggcgggctttatcctgcgcggcaacggtgccgatctgcagcaggagctctggggacgtcgtattcagctcatcgcagctatgatcgcctttgttgtgtcgattccgctggtctggtacgcccataccttcttctttgctgacaacctgctgccgcctgtagcgcgggtgtatgccaaaaccattcaggcgggtgctgagccaggtatcgccggtaatctgctgatgtgggcgattccgggggccattatccagctgatcggcggacccaaacgccagctgggcgtgctgctcgccaccggtttattaattaataacgccatggcgggctgggcagtggtggtggggatcgccttacgcattgtaatcatccggatctggggcgagcggggccggtcgcctatggaggtgatggcggcaggctttattgccggtgatgccctctacagcttctttcattcgctgtttgccagcagcagcaagaaataaaggataaagcatgagtttgcagcagaccctggcggtttttgagttactggatagcgcccacattgacggacagcaggtggtggatctcttcgcggcgtatcctgatgttgatgcccgctttacccgtgtctccggtcccaaaggccgcaccgattttgtgcgcattgatattccggggacgcagggcaaatcaggcggcggcagtgcaccgacgctggggattattggtcgccttggtggcatcggcgctcgtcctggtcgtatcggcatggtgtcagatgcggatggcgcgatcgcggccgttgccagcgcgcttaaactggcgcagatgcagagcaaaggcgacaggctcgatggcgacgtcatcattaccactcatatctgcccggatgcgccaacgcggccgcatctgccggtcgatttcatggactcgccgattgacgatatcaccatgaatgataatgaagtggtggcgggtgtggatgcgattctgtcaatcgacaccaccaaaggtaaccgcattatcaaccacaaaggctttgccctgtcgccgacggtgaaagagggctacatcctgcgggtttcggaggatctgctgcgcatcatggagatgaccagcggccgtccggcggtgacctttcccatcaccacgcaggatattacgccttacggcaatggggtttatcacctcaacagcattctgcaaccttctaccgccacggatgtgccggtggtgggggtggcgatcaccgccgagtcggtggtgccgggctgcggaaccggcgccagccatgaagtggacattgcggcagcggcgaagtttgccattgaggtggccaaggagtttggtcgtggaacctgtcacttctacgacgccgaagagtatgcgcggctgatttcactctatggcagcctggcgcatctgcgtcaccggaatcactaagatgacgaaaccactggtaacgctgactatcggccagtctccgcgcagcgatattctgccgctgctgcggcagcatctgccggatgcgctgaccgatcacgccggtttactggatggactcagcgcggcagagattgccgcacgcttcgcgccagcagcgggcgaccgggttctggtgtcgcggctgcagagtggcgaacaggtgcggctggcggcctcgaaagtggagcagggattgcagcgcaaaatcagtgcgctggaacaggcgggctatgcgatcattctgctgctctgcaccggtgaattcagcaggctccgtacccagcgtgcgctactgctggagccggatcgcctgattccaccgctcatctgcgccatggtgcagcagcagcgggtcggcattgtcgtgccggttgaggagcagattgttgagcaggcaggtaagtggcagcaactgcccgcgcagccctgctttgcggtcgccagtccctatcagggcgatcaggcaaccttcgccgatgctgcaaacagtctgaaagcgcagggcgcggcgctggtggtgctcgactgtatgggttatcaccagcagcatcggatagtgttacagcagcggctgggcgtaccggtttctgctctctaatcagctggtggcgcgcctggcggcggagttgcttccctgagtgaagagatcacaaacggccatcatttcgcgtgacagatcagcgggttcccttctacactgccagacacacaacatgtgctctggagaactattatgctcaacgtaagtgagtattttgacggaaaagttaagtctatcggttttgacagtgcgagcaccggacgtgccagcgtgggcgtaatggctgaaggcgaatacacattcggtaccggccagccggaggagatgaccgtggtcagcggctcgcttaaggtattactgccaggtgaaaccgagtggaaatggtttgaagcgggttcggtgtttaacgtgccgggtcacagcgaatttcatctgcaggttggcgagccaagttcctatctctgccgttacctgaaagattaaaaaaaatggccgcttagcggtaatgctggtcagttaagattagatttgtaaaggctgtcacggtcaaacgtggcagcttttttgtcagggcgagcgtgccgcagtgcgggccagcgcacctctgctgctgccgggccgtcctcgcgccgctcacgcggttccttcggctttgacgttgtgccgacgaaccgttcggggatcggccctccctggccggccccgaactgtccacgcttcccggcgtggacttctggcccaccgtcacgcctcagcgctgcggatagccctttcagcagcagaggcgctcaggcctccactctcgtgccctttttaacagcacgcaccagaagcttaagagcagactggtggcgatcaggagcaggcaatccgcagcgctgaacagaatgagtctgccaggagagcccgcaggacgcgggcgaaaggcggggcggcacaggatgtgccatccccggcggtccgtcaggcaggcgaatgaagtgaaggaaccgcgaagcggcgcgaggaccgccagcccctgagcggcaccagactgcgttatcacctttcgcttaactgactgacattaccgcttagcggccctttttttggcgaatatcgtctgtcaggatgattctgccggtgactgattaacgctgggcttcgccgcccaacgcttctaccagattgctggtcagtgcggccagtttcgctggtcatcagaataaagtccgcatcaaagcgctgtgcaaaatcttcgcggtcaatatcgtcgttctggtcgcgcagcgtgtcgctgaacttcagacgcttcactgaaccatcatcggccagcacgaactgaatgcgctcctgccagtcgagcgccagtttggttaccagcttgcccgcttcgatgtggttggcgatctcatcgcacaccagatcctgtttcttgcagcggataacgccgccatcttccagcagcgctttcagctccgcttcatccatcagggcgaatccggcaggcagctcgcctgaacgtacccattctgtcagggtcagttcaatcgggctttccagcgtcagcggcaccaccggcagtgagcccaggcttttacgcagcagcgcaagggtatcttccgcttttttagcgctggcacagtcaacaataatcagattgttgaccgtatcgatccagaggtaggtctggctgaaacggctgaaggcgcgcggcagcaggctgtgcagcacttcatctttcagcgaatctttttcggtctttttgagcttgcggctctgctcagattccagcttgtcgattttcgcttccagcgcctgtttcaccaccggcgaaggcaggattttctcttctttgcgggcgcaaatcacaatctggcctttgttttcatgggtcagcgcatcgctgcggttgcccatcggcgagacccagccggtcttgctcatatcctgactgccacacggtgaaaacgtgaaggcgtcgagctgcttttccatctcatctgcggacagcggaatgtcacgattcagacgataaaccatcatatttttaaaccacaacatcgggattccttaccgtggcgcgatcgggcgcacaagtctgcgagagtcagcgcgcatgatagcgaaacatcggagtggtttcattgcctttccggcagacgccttttactgtatctctcacctgaacgaataacgaggacgtaatcttgcgcataggcatagatctgggtggcaccaagacagaagtgatcgcattgtcggataagggagaggagctgttccgccaccgggtgaataccccgcgtgatgactatcaggcaacggtgcaggcgattgtcgatctggtcacgctggcggagcagaaaaccggcgcaaccggcacggtcggcctcggtattcccggcacgctttcgccctacagtaagcgggtaaaaaatgccaactccacctggctcaacggtcagccgctggataaagatctggcgcaggcgctgaaccgggaagtgcgtatcgcgaacgacgccaactgcctggcggtgtcggaagcgatcgacggtgccggtgccggacagtcgctggtgtttgccgtgatcatcggcaccggatcgggcgccggtgtggcgatcaacggtgagtcgcgtatcgggggcaacggcaatgccggtgagtggggccacaatccgctgccgtggatggatgaggatgagctgcgctaccgtcaggaagtgccctgttattgcgggcagcagggctgtattgagacctttgtttcaggcaccggttttggtatcgactatcagcggctgagcggcgtacatcgcaaaggtgcggagatcgcctcgctgctggcgcagcaggatccgatcgccgaactggcgatgagccgctatgagttgcggctggcaaaatcgctggcgcaggtggtaaacctgatcgatcccgatgtgattgtactgggcggtgggatgagcaatgtggatcgtctctatcagaccgtgccggtgctgatgaagaagtgggtatttggcggggagtgtgaaacgccggtgctgaaggcgcagcatggcgactccagcggcgtacgcggtgcggcgtggctctggccgcttaacggctgagttacccgagcatccgctgacgattcagcgccagagagacccggcgctgaatcgttaacccacggcactcacccgcgccgcttttattcgccgaccagcatactgtcctgcggcgcccgatcgcgctgcgctttggtggcgaggaagtaaagatagcctgccagcatgatggcgaaaaacagcgcgccaatcaccggattaaaccacagcatcgccagcagacagactaccgacagcagcagggcgatgcccggaacaatcggatagcccggcgcgcggaaactgcggaccatctccggcgcgctgcggcgcagtttaaacagactcagcatactcatgatgtacatcactatcgcgccaaataccgccatggtgatcatcgccgccgtcagcgtcatcccctgcagattaatcacaccatcgctgtaaattgccgcgatacccagcacgccgccgagaataatcgcccgatgcggggtctggaaacgcgacagtttggccagagaaggcggcagatagcccgcgcgtgccagggcaaaaaactgccgcgaatagccgaggatgatgccgtggaagctggcaatcaggccaaacagtccaatccacaccagcatatgcatccagttagagtgttcgccgacaatcattttcatcgcctgcggcaacggatcgttaatgtcggcgagtttgcgccagtcgcccgcgccgcccgccatcagcatcacacctatcgccagcaccaccagcgtcagaatcccgctgatgtaggcgcggggaatggtccgggtcggatctttcgcctcttcggccgccatcgccgcgccttcaatggcaaggaaaaaccagatggcaaaaggaatggcggcgaaaatgccggagaaggcgggcagtccgaagctgtcactgcctgcccagccgtgcgcggcaaagttcgccaggctgaagccgggtgaaaccacacccataaacaccagcagttcaatcaccgccagcaccgtcacaaccagttcaaacatcgccgccagttttacgccgagaatattcagcgtcataaacaccaggtaagccccgaccgccgcagtcttcgggttcagtttcgggatactgcacgttgagataagccccaatcgccatggcaatcgccggtggcgcaaagacaaactcaatcagcgtcgccagaccggcaatcagtccgccggtttcgccaaaggcgcggcgactataggcaaatggcccgcctgcatgggggatcgcggtggtcagttcggtgaagctaaaaataaagcaggtatagagcgtggcgatcaacgcggtggtgaccaggaatcctagggtgcccgccacagcccagccgtaactccagccaaaatattcgcctgaaataaccaggccaaccgcaatcccccacagatgcagggtgcccagagtgggcttgagtctgtttgtcattctgttatccccgtcgttgttggtctcacgcggcgttacaccgccattacgctacagtaaggggataatgccgttgcattactcgccacgacttgacgcgggcgcagtgacttctgtcctccacggtcaactcacgggcaacaaccgggccagctgcacgctgcggtcaactttgtctcttccggagtcaagcagctcaccttccggcaacgcatgctgagataacgcaagtgacaaggagccggactgatgagcgctaaacaatatgacaacctgactgattcccaactcaccctgatggcgcagcaggcgctggcctgttatcccgccgcgctgcagggccagctcagcctgctgtgccgctcagagaacgccacgtttctgctgcaggcggcaggccggcgttatgcgctgcgactgcatcgcggcgattatcatcaaaaagccgacatcgtcagcgaactgctgtggctcaatgcgctgcgcgaaaccggcattatggtgccggaagcggtgccggacaaagagggcgaaaccgtgctgacgctgcggctgccggagggcggtgaacgctacgtggtgctgtttcactggatcgacggagagatgccgaccaccgacgtcgatcctcgcgcctttcagcagctcggccagatcaccgcgcggctgcatcagcacagtaaacagtggcagccgcctgcgggtttccagcgcatcatctgggatcaccacaccatgaccagcgcagagagtcactggggacgctggcaggatgcgccgaatctgaatcctgccgatcacggcgtgttagagctggcgataagccaggtcggcgcggcgatgacgcagttcggtaaaggatcggatcgctatggcctgatccacgccgatctgcggctgaccaatctgctgctgcacaagggcgaaacgcgggtgatcgatttcgatgactgcgggctaggctggtatctgcacgatctggcggcggcgatcagttttgttgagcatcatccgcgcgcgccagagtggatcgatcactggatccgcggctatgagcaggtggcgcatatcagcgatgcggagatggccatgctgcccgcgctgttaatccagcgtcgtatccagctcaccgcgtgggtgggatcacatgccgaaaccgaaatggcgcgcagcctgggatcggcgtgggccagccactcggtccgcctctgccgccgttatctggaaggtgagcagctgccggtcggcgtctgatgcaccagcggcgggcgccgctgcgccgccgcagtgccctgcgcgtaacctgcacgccgcccggacagcccgcaggcggcgcgtcgggcatcagggacctggtatggaaattgctcggataggagtaacgggtgatccacctgaattctgactgaggcgaccatgaatccgacactgataaagcccgatgcgtttgcggcctgctcggcagcggcgggggcaggcaatcacggcgtgctggcagcggcggcgaccggcttaggcgactttattcatacccagggcggcgatgttgatcgcatcttcggcatcagcggcatcgatccggagcgcctggccagtccgacgctcagcctggggctggttaactactgtcgggtgctggaagaggcggcgcgtcactccggttttgataacttcggtttgcactacggcaggcagtttaaaccgcagtcattaggcctgatcggctacatcggtttgtgctccgccacgctggaacaggcgctgcataatgtggtcaacgcatttccctggcatcagcacgacaccttaacccggctggtggataagggagagtgctggcggctggattatcaggtgcgacatggcgcgattctgtcgcgccgtcaggatgcggagctgacgctggggatgtttatgaatctgatccgccacgtggcgggcagacactgggcaccgcgcgaagtccactttgaacatccgcgtcccggccagtggcacgatcactgcaaagtgtttgatgcgccggtctggttcgatcagccgtttaattcactggtgatccccaagcgcgatctgctgcgcgccatgccggagagcgatccgatcctgttaatggtgatgcaggatgcgatccgacggcttaaccgtgtgacttcacagcagagcatgattgagcaggcgcgtttcgcaggttaatttatcgctgatgcagggtgagccggtactggaagaggtggcggataagctcggactgtcgagctggtcactgcagcggcggctgcgtgaagagggcagcagctttaccgcgctggtcgatcaggtgcgctgcgaaatggcgacacactatctgcagcagaagcagctgcccatctctgagatggcgctgctgctgggctactcggaagtcagtgcgttttcacgcgcctttcgtcgctggtttggcatcagtccgcgccagtggcgtcaggaaggtctggccagctaaccgcgcggcgcaaagccgaaccacgccggttgtccaggctccggcggcggcggcagatcacgggtctgcgccaccagctgccaggcgcgcaggcagagcgcttcatccccctgcgtctgggtcaccgcataacgtctgctgtattcctgccattccatccgtaccagacattgctgtccggcgtaacgcgccgcatcgctgaactgccggttcagtactggctgcatttgataagtccagtgacaggattggctgtcaggatatttcgacggctgacagaggtttgccacgctatcccgttgctttgccacaggttgctgacaggcgctgagcgacattgcaataatcacccccggcaacattctcatcgttatattaattaaattcatttaactggccaactttcctttaagatcttccggtctgctgccgacagtctacagaccggcatcatgaatgctatggcattactccgactgtcgacagaaccagaatttaccgccatggcgcgggttatccctgcggcagttccagctggctgtaacccagcccattcatcttgcgtactttaatctgtaccggaatgcgctccttcatcgcttccacatggctgatcaccccaatggttttgccgctggcgttgagtgcatcgagtgcgtccagcgcggtgtcgagcgtctgcgcatccagcgtgccaaatccctcatccagaaacagcgattcgatgcgcgttttgtggctgaccagatccgacaacgccagcgccagcgccagactcaccaggaagctctcaccacccgacagcgtgcgggtatcgcgcgccgcatcggcttgccaggtatcgaccacatccagctccagcagatcctgcgcccgtcgctgcagcagatagcggccatgcagccgatcgagctgacggttagccagggccaccaggtgatccagcgttaagccctgggcgaagcgccggaatttatcgccgctggcggagccaatcagatcgttgagcaggctccactgcgccagcgtcacaccatcctgttcaatctgcgtcatcaggctttgctggcgcacacgaaggctggcatcgctgtgcagctgctgctgaatctgaccctgctggctggcgttgtcgcgcagtgccagccgtaactgctccagctgttgcgccagcgcctcggcggattccggcatcgcagcgggtttcgcctgctgatggagactgagccgttggcgcagatccgccagtcgcgcctgctgctgctggcattgctgatcgagctgctgcaactgctgacgcagttgcactgcggtctgctcatccagcagcgccgcgcgcaggctggcttcatccgcaaatccggcgctctccagtgcctgctgcagcgcgctttccgcctctgccagtttgctattgagcgtctgccgctgattttccagccccgaaagctcaccctgcaggcgactgacctcggcctgcgcctgttgcagggcagtgagttgctgtgccagttgttcatcagcctgctgaacgcgggcctgtatctgctgacgggcgtgggtgacctcgcggtcgccaaacagcgcgagacgctgctggcgcatctcgctgagctgcgtctggcgctggttttgctgctgctgacgagtggtgagctgctgctgctccagtttctgcctgctgttgcagggcagtgagctgggtttccccctttaacagctgcggttgcaggtttgctagcaaccgctcactttcctgccagcgctcccagcgccgctgctgttctgtcagccacgcatcgcgatgggcggcgtcgggcagggcaaggttgtgtgcactgaactgctgctccagacgactctgcaattgcgccatggcctgctgttcctgctgctgacgctgttgcagcgcatccagcgcctgttgcaggctggacagcgactgctgcgccagctgttctgcctgcaaatgctgctgccaggcctgtgactgctgaagatagtaatcttttgcggcctgacgcgcctgttctgcggcttcctgcgcctgtcgctgttgctcaagctggctttcacgctcgctttgctgctgctcccacgcggttaaggcatcccgatcggcgagcgggaaggtaagtgccagctcactgctcagcgcctgccattgctgctcaagccgatcgagctgttgctgcatctccgcgatttcatcgcgcagggtctgctgctgcacggctgactgtttcagctgttcgctttttgccgtgcccgcttcgcgcaatgcctcggtttgttgttgcagtgcagcccggcgctgctggttagcacttacttccagcgtgctgtaggcctcaacggcgggatgcgtgcaggagccgcacagcggacagggctgatcagcggcgagccgggcgcggtaatcgctgagatcaacaatctgctgctccagcgcgcagattttttcgacatcatccagttgctgttttccgcgtttccacgtctcgcgcagggcctggagttccgcttcactttgctgatgcgcttttgcgagcgcgataagccgctgctggcgctggtccagctgctggtgcagcggctgccactgggttgaaagcagcagcagttgctgacgagccggacggctgttctgcaactggcttaatgcctgacgcagtgcggcaggcggatgctgttcctgtagcgaagttagtacttgctccgcctgcgagagcgcctggcgggcctgttgctccgcctgctggcgcggaagcgcctgttctgcctgctgctgctgttccgcctgctgggtagcgatctgtcgctgctgctgctcgcgctgttgcgccagtccggccagggtcgcttcacgctgcgccagcagggcaaagttctcctgccacaccggcagcgaagcgccccattgggcgagatcggcaagctgctggcgtaactgatgctgttcggcaatcgcctgctgccatgtctcaacctggcgcttctgctctgccaggctggcctgtgtctgatcagcatgctgctgctgtcgggcattttcctgctgctgctccgcaagctgctgctgcagtgcgctgatccgctgatccagcggcagaacctgttctgtcagcagactttcctgctgctgctgttcctgcagcgcctgctggcgggcactctgggtcgtcgcgtagtgctgttgatgctgctgctgttggctctgcgcctgctgctgcgccgacgtgagttgctgacagcggctcacgacctgctgctgtttcggtgcgtaacgcgtcgcgctgctgcagttttacccgcagcttttcagccggttcgctgcgtgcaagacgctgacgatcggcctctgccgcctgggatgcagcctgggcctgctgcagcgcgacgtcagcctgcgcatcttcctgctgtaactgctgcgcctgctgttgccactgctgctgttgctgcgcctgctgatagtgcgcgctgagctgctgttccgcatcggtcagatcggtgagctgctgttgcagcgcggcgcgtgcgtcgctatccagcagcgccatcgctcccgcctggctgcgcagcagatccagctgggtttttgcctctttgtggcgctcgtagatggcggcggaaatcagaccgtaaatttcggtgccggtcagctcctcaagcagttccgcgcgctcactggctttggcattgagaaaggcggcgaactggccttgtgacagcatcatcgagcgggtaaacctttcgaaatcgagcccggagagggtttcgatcagcttcagcttgtcaccgactttatcggcaacaatagtgttgtcagcgcagcgtgccagctcaacgcgcggcgcctgaagtttgccgtcagcagtgccgcgcgcgcggttctggctccagaaggcgcgccaggcttctcctttgatctcaaactccacctcggccagacattcggcacagtcgcgggtcatcagcgcattctggctctgtgaaatcgcgcccaggcgcggtgtctggtgatagagcgccaggcagatggcgtccagcagggtggttttaccggcgccggtggcaccggtaatggcgaacaggccgttgctggcgaaaggttcggcgcggaagtcgatgaaccattcaccgcgcagggcattgaggtttttgaaccgtagcgtgaggatcttcattgggtctcttccatggcggccagcgtctggcggaacagggtggtcatctcggcgatttgcgccggttgcagctcctcatccagcgccagccggcgggcaaagacctcctccaccttcagctcactcagggtttcgttgtcgagccgcgccaggctctgttgccgctgttcacggctgcggcggagcaacaggacttcgaccggcagcgtggcggtcagggtttctacctgacgctgcagatcgctgaggtactcctgggtggtgacttcgatgtcgagccaggtcggcttctcctgctctgccgtgctgaaggcatttaactgctctgcaatctgcgccagcgatcctttcagcacctgcatcggctgcgcctgtggcaccaacagcggcgtgaccgattgcaggccgctggtggtgagttccagcaggaagacgcttttttctgtgcccagctcgtcaaagctcagcggaatcggtgagccgctgtagcggatatgctcgctgcccgcgacgcgctgagcgcgatgaatatgccccagtgcgatatagtcagccgcgggaaacgcgctggccggaaaggcatccagcgtgccgatatagatgtcgcgcactgaatcgctctggctgacgccgacggtggtgagatggccggtggcgataatcggcagtgcatggcccagcgcctgggcggcggcgaatcgctgctgatagtggtgggcgatcgcttccagcagcgaggtctgcttgtcgcgtcccgactgacccgcccggctgcgcaggatatcgcgcggccgcagatagggaatcgcacacagcagcgcgcccggctcgccctggcgggtgttgagcagcagcacatcatccttctcctgcggggtggcgatcacccgggtattgaggcaggcgagcagctcacgcgactcattcagcgtggcaacggaatcgtggttgcccgctagcacaatcaactgacagccgctgggctgcagcgccaccacaaagcggttgaacatttcgcgggcgtagctgggcggtgtaccggtatcaaacagatcgcctgcgatgatcaacgcatccacctgatgctgttcaatctggatcaacagccagtcgagaaatgcctgatgttcggctgcccgacttttgttgtagaagaactgccccagatgccagtccgcagtatgaatgatgcgcatgatgagtccctgccgttgtgattcgcccggcgattatactggctctgcggccaaagcaaaaaattgtcgctgcgctgtcataaatgattaccagtgaggttacaggcaggttatgtttttcataaaagtgtcacaaatctgacgcataatggcgccgcgaatctcagtgacatccgtcataatcagcaggagtaataatggctaagcgcattttggttgtggaggatgaagcccccatccgtgaaatgttgtgttttgttctggagcagaacgactatcagccaatcgaggcggaagattatgacagcgccgttggcaagctgattgaaccctggcccgatctgattttgctggactggatgttacccggtggcagcggtattcagtttatcaaacatctgaaacgcgaggcgatgacacgcgatatcccggtgatgatgctcaccgcgcgcggcgaagaggaggatcgggtgcgcggcctggaagtgggtgccgatgattacattaccaagcccttttcacctaaagagctgatggcgaggatcaaagcggtgatgcgccgtatttcgccgatggccgtggaagaggtgattgagatgcaggggctgagtctggatccctcctcacatcgcgtgatgtccgaaaccacgccgctggagatgggtcccaccgaatataagctgctgcacttctttatgacccacccggaacgcgtttacagccgcgaacagctgctgaaccacgtctggggcaccaatgtgtatgtggaagatcgtactgtcgatgttcacatccgccgtttacgtaaagcgctggaagtgtccggccacgatcgcatggtacaaaccgttcgcggaacagggtatcgtttctctgcccgctactaaacggagcctttaccgtgctggaacgcctctcctggaagagattactgacagaaaactgctgctggtctgtctgcccgcagtgctgctgggcctgctgttcggcggtctgccctggtggctgctgctgagcgtgctgacggtgctgttgtggcattttcacaatctgatgcggctgtcgcactggctgtggctggaccgcaccatgacgccaccggccgggcgtgccagctgggaaccgctgttttatggtctttaccagatgcagctccgcaaccggcggcggcggcgtgaactgggcaatctgattaagcgtttccgcagcggtgccgagtcgttgccggatgcggtgatcctgaccaccgaagagggcaccattttctggtgtaacggcctcgcacaacagcacctgggtctgcgctggccggaagataatggccagaacatcctcaacctgctccgttatccggagttctcgcgctatcttcgccagcgcgatttcgacaagccgctgacgctggtgctgaacaacaaacttcacatggagttccgcgtcatgccctacagcgaagggcagtggctgctggtggcacgtgatgtcacgcagatgcatcagctggaaggggcgcgccgcaacttctttgccaacgtcagccatgaattgcgcacaccgctcacggtactgcagggctatctggagatgatgaacgactcggtgatgagcgagccttcgcgcagcaaagcgctgcacaccatgtcggagcagacgcgccgcatggacagcctggtcaaacagctgctgacgctgtcgcgcattgaagccgcgcccgcgatcgatctgaaagagaaggtcgatgtgccggtgatgctgaaactgctgcagcatgaggcggcaacgctgagtggcggccgtcacgacatccacttccataccgatccccatctgaaagtgttcggcaacgatgaacagctgcgcagcgccatctccaatctggtttacaacgcggtaaaccacacaccggatggcacgcgaattgatatcagctggctgcgcggcaaacagggggccattttccgggtgtgcgataacgggccgggcatcgcctcagaacatattccgcgtcttaccgagcgtttctaccgggtcgataaagcgcgtttcgcgtgcgaccggcggcagcgggctggggctggcgatagtgaaacatgctctgagccaccataacgcgcggctcgatatcaccagcgtgccgcacaaggagacctgttttacctttacgctgccagcgaggttgattgtcagcagcgtgatgcaggagaatgccgttcattaatcgctgccggatctccctgatgcgcatccttcttttgttgatcgttactctgctgccgggcctggcactggcccagcccggcgcgctctccggcaatctcagcagcgtcggatccgatacgctgggctatctgatgacgctgtggggcgaagatttcagtcgccaggcgccgggcgtcaatgtccaggttcaggcctccggctcttctactgcgccgaccgcgctggcggcaggggcagcacaactcggtccgatgagccgcccgatgcaggcagatgaacgccaggcctttgaggcgcgctacggctatccgccgctggcggttccggtggctatggatgcgctggtggtagtggtgaatcagcgcaatccgctgcagcagattgaaccgcgtcagctcgatgccatcttctcgattacccgtctgtgtggcgcacacagcgtgccgctgcgctggggcgatctcggcttaaccggcgcgcagtggagcaaacggccgattcagcgctatggacgtaactccgcctccggcacctggggtttcttcaagcagcaggcactgtgcaaaggtgattttcgcagcgacgtggcggagtttcccggttcggccgcagtggtgcaggcggtggccggtaattcacgcagcatcggctacgccagttttggctttcatctcagcggcgtaaaaatgctggcggtgatgaatgatcaggggcaggcgattaccccggatgccgatgccatccgcagtggccgttatccctgggcgcgcccgctctatctctatgtgaataaagcgcccggcaaacctttgccgccgctggtggccgcgtttctgcagcaggtactttcggcacagggacagcggcgggtcagcgaagcgggctatctgccgctctctgatagtcagatgatgcaggcgcgcgccgcgctgcgttaatcccccgaacgtgaatttttttcaacatcactgaattttcttcagttgcagaagaaagccgctcatgacactctgtgttcagacatgtagccatccagatggctatttatatcaggatgcaactatttcctgccgtcattaccggcaggagagacaggagtgatcatgcaaagagaaaccgccccgttccgtgccgataccgttggcagctttctgcgtcccaccgccattaagcaggcgcgcgaacagtttgcagccggagagattgatgcggcggccctgcgtcaggttgaagatgaggcgattcgcgatgtggtggcgaaacagcgggaaaatggcctgaaagtggtcactgatggcgagtttcgtcgcggctggtggcacttcgactttttctatggcctgaatggcgtagagcgctatgaagcggagcagggcatccagtttaatggcgtgcagaccaaagcgcatggcgtgaaagtggtgagcaaactcggtttcccggcggatcatccgatgctggcgcatttccgcttcctgcagagtattgccggtgatgcggtgccgaagatgaccattcccagccccagcgtgctgcacttccgtggtggccgtaaggtgatcgacgcggaagtctatcccgatctggcagactacttcgacgatctggcgcagacctacaaagcggctattcaggcgttttatgacgcgggctgccgctatctgcaactggatgataccgtctgggcttacctctgttctgaagatcagaagcgtgatatccgtgcgcgtggcgacgatcctgaccagctggcacagacttatgctcaggtgttgaataaagcgctggaaggtaaacctgccgatctgaccgtgggtctgcatgtctgtcgcggcaacttccgctcaacctggatctctgaaggcggctatgggccggtcgcagaaatcctgttcggcagcgtcaacgtggatgccttcttcctggagtatgacaacgcccgttccggcggttttgaaccactgcgttacattaagccaggtcatcagcaggtggtgctgggtctgattacgaccaaagtgggagaactggaggatccggcgcaggtgaaaaaccggctggaagaggcggcgcagtatgtcagcctggatcaaatctgcctcagtccgcagtgtggttttgcctcaaccgaagagggcaacagcctgaccgaagcgcagcagtggcagaagattcgcttagtggtcgatatcgcgaatcaggtctggtagtgctgtaacgttgtgcagacaggcgcgtaaaacgcgccttttgtgtatcttcaggcccgtttatgcggggatttctcgcgctctgtctattatttaggcacatcatcttgtgtgcctgctgcaaaaattaacgctatccactgccttttgaaaaaatggcggcataaccttctggttttccgatcccgtattgcctttcaccgctataaacgttttacttagcgccgttgtcgatccatccctctgtgaacagaataaaagcagcttaaatcacctgcgctttaccctgcgacgagcataatgcgctgacattgtcagcctggtcgtggtttacacgcagcgaggggacaacactaacccaacttccaccgcaacatcagtgacaggccgtatgacacatcgtttaacttcgaaggacattctcgcgctgggctttatgacattcgccctgtttgttggcgcgggcaacatcattttcccgcccatggtcggtattcagtctggcgaacacgtctggactgccgcgattggttttctgattaccgcagtcggtctgcccgtgatgaccgtgatcgcgctggcccgcgtcggcggcggtgtggatgcgctcagcaccccgattggcaaggtcgctggcatcgtgctggccaccgtttgctatctggctgtcgggccgctgtttgccacaccgcgtacggcaacggtctcgtttgagatgggtattgccccgctgaccggtgatggcgcgctgccgctgtttatctatagcctgatttacttcacgctggtgattggcgtatcgctctatcccggcaagctactcgacacggtagggcacttccttgcgccattaaaaattattgcgctgaccgtgctgggtgttgctgccctggtgtggcctgctggcggcacggttccggctaccgctgattatcagcgtgcggccttctccagcggtttcgtcaatggctatctgaccatggatacgctgggcgcgctggtatttggtatcgtgattgtcaacgccgcccgtttcgcgtggcgtcgataatgccgcgctgctgacccgttacaccgtgctggcggggttaatcgccggtctgggcctgacgctggtctacctctgcctgtttaagctgggcgcgggcagcggtgcgctggtggatcaaaacgctaacggcgcagcgattctgcacgcgtatgttcagcacacctttggcaacatgggcagcttcttccttgccgcgctgatcttcgtcgcctgtatggtgaccgccgtaggcctgacctgtgcctgtgcggaattttttgcgcaatacctgccgttatcgtataaaacgctggtgtttattctgggtctgttctccatggtggtgtcgaatctcggcctgagccacctgattcagatctccatcccggtactgacggcgatttatccgccctgtatcgtgctggtggtgctgagtttcaccctcaactggtggaataagagcagccggattatcgcgccagccatgttaatcagcttgctgttcggtattgttgatgcgattaaaaccaccgggtttaaagatttgctgcccgctttcagtcagcatctgccgctggccgatcagggtctcgcctggttgccgccgtcgctggtgatgctgctgattgccgctgttgttgatcgggtgaaagggccggaacaggtgaccgttcactcgtagcagagagcactgatttttctttaaccacgggcctgcccgtggttttttcatttcacaggtacaggttgttatgcaagaaaccaacaagctcaaacgcggactgagcacgcgccacatccgctttatggcgctgggatcggcgattggcaccgggctattctacggttccgctgacgcgataaaaatggccggaccgagcgtgctgctcgcctatatcatcggcggggcagtggcttacatcatcatgcgcgcactgggtgagatgtccgttaacaatcctcaggccagctccttctcacgttacgcgcaggactatcttgggccgatggcaggctacatcaccggctggacgtactgttttgaaatcctgatcgtggcgattgcggatgtcaccgcgttcggcatctatatgggcgtctggttccctgaggtgccgcactggatttgggtgctgagcgtggtgctgatcatcggtgccgtcaatctgatgagcgtgaaggtgttcggcgaagtggagttctggttctccttcttcaaagtcgccaccattatcgtgatgattctggccggtttcggcatgatcatctgggggctcggcaatggcggccagccgaccggcatccacaatctctggactaatggcggcttctttgcgcacggcgttgtcggtatgctgctgtcgctgcagatggtgatgtttgcctatggcggtatcgaaatcatcggtatcaccgccggtgaagcgaaagatccggagaagtcgattccgcgcgccatcaactcggtgccgtggcgcattctggtgttctacgtcggcacgctgtttgtgattatgtcgatctacccgtggaatcaggtaggaacttcgggcagcccgtttgtgctgaccttccagcatctgggcattgcggcggccgcctctatcctcaattttgtggtgctgaccgcgtcactctcggcgattaacagcgatgtgtttggcgtaggccgcatgctgcacgggatggcgcagcagggacatgcgccgaaggtctttatgaaggtctcttcgcgcgggattccgtgggtgacggtggtggtgatgatgttcgccatgctgattgcggtttatctcaactacctgatgccggaaaaagtcttcctggtgatcgcctcgctggcgacctttgcaacggtgtgggtctggatcatgattctgctgtcgcagatcgcgttccgtcgcaaaattggcaaagaggctgccagtaagctgcagtttgcgctgccaggcggcagctggactgctggcgtcggcgtagccttcctctgctttattatcggtctgattggttatttccccgatacccgcatttccctctatgtcggtatggtgtggatagtggtgctgctgctgggctataagctggttcgtaaaccccgctaatctcctgttctgctctctcattcgtgggggagcagaacacgctatttcccgcgcttttatattcctgctcatctgattatttatgtgacccaatccacaatattcaatcctgttatcaggagcaaaacgcctgcctgcgaaataagtttatgtcccggtttatatccataaatgcgtattttaattggcagtgaatgtggcggatagtgataaccgggcagaaagcgataagggagattcagaggagtgagcgtgcagtcacacaggcgctggcgggcagcagtagcggggcgtgtaagaaataaaaaacggcgaaaccagtcgccgaaatactcaagaattacaggaaaatagttaataaagggatgattgacgggtctatcgtaaaacaaaacgagtggcgctgatagtcaggcgatttaaataagaaaaggtcggaatggcgttaattaacagcggttaacattattcaggccgcgttgatgctgcggcctgaatttgattagccacagactcagggcaatataaccgaaaccggcagcacagcgctgttatccagcttttttcgtagctgagtcagcgtgaattgataagggcagagcaggccgacatcggtgattctgcagtcatgctgatgccactcctgacgtaataacggatgtttatcatcaatcggttgcagctgacgaatcccatccagactctgcgcctggaaatagagccgcaaaaaacgttcgccgctgtgggtgtcgcgccagcgctccagcaccagactactgcccggtggaatgttgccgcgtgaatagcctggcaactgccagctaaagcccatcagggtgcgcaccatcgcaatattggtgtcatgtgccaccagaatcagccagcggcccggcgcgctatcggaagcaatcgcctccagcagggcgttgagcaatattgagccacggcgctgtgcctgatagagcacgtcgttgctgagatcgtagtttgcggtcagcagcggcagcagcgtggtgatctgcgcggccgaggtgatgtgtccccaggcgagctggtccaacggcaggttttcgctgtagcccagtcgcagcgtctccaccatgcttgccatcacactcagcccgtaaacgtatgtgttgccgttacgggtttgccggaacgaccagggcgcatcaaagagggggcagtcagtcgcgggcgggcagacggcggctttcagctgctgaatagcgggttgcaactgctgttgcagccgcgccagatcgcccgctttctgctgcttagccgccagctcctgagcaggatcgctctgggtgatcgtcagcttttcactctgaaacaggggatcgacttcgcccgctacgtgatgcaccggcacgccgcagccgggaaaggccccgtcagtcagcgctgcggccgtggcacgggtgcgctgcagcggactggcgcgcacgtagacctgtgctgcatcaggacagcccgcgcccagcaggccgagatggcgatagtgctcgccttgccagcgtcctttattgaccaccgcgctgtagccatgaccggtcagctcaccatcggcgctggtccactgcgtccagggttgctggctggcggcttcaatctctttgcgattgccgggggtgggcggacggacaccgtgacggctcagttcgaccaccttctccagctggtaatccgccgcctgtgacgccggacttaacagccagagagaacagaggatcagcgcgcagcggtacaggcctggcagcgtcatttactcctccagcgcgcgattaccggtcagcgctttgatttttggataaagagtcgcattggccagcaacaccgggttgccgttttttagcccctcgttgcgcagataatcattagtgacgccgcccgcttcgcgcatcaggacgatgcccggcagactatcccagggatgcatatgcgcttcatagtagccaatcagtcgcccggcggccgcccaggcgctggtcagcgcgccagaaccgatgcgaataaacatgccaccctgttcagttaagccgctaatcaggcgcgagacgctttcggcaggggtgcgactggagttgctgatgccgagcaaaccctcgttgagatgcgtcgcgctatgaacctgcaaacggctctcattaacccacgcaccctgacctgctcgtgcgtgaaacagctcctgatgattgggatcgcagaccacgccgattaccggttcgccgtcacagaccaccgccagcgagacgcaccagttaggcaggccgttgacgaagcaggcggtgccgtcgatgggatcgaccacccagataaagggcgcgccctgaacctcaccaccgctctcttcgccatagacagcatcgtcaggaaagcgctcagcgattaatgtcttaatcaatgcctcaacgttacgatcagcctcgctgaccacgtcctgcaaatcccttttgtgttccaccaccagtgtctgacgctgctgataccacgaataagcccggctggccgccgcacgggcgatgtcgcaggcgtaacggtaacgcgcgtcaatttcagaatgcgaagcggatgacatcttttcctcttatgtcttttggtcaaaacgaacggaaggcacgcctgaacaggcggtctggctgtgatatttacttaactattgttaagaaaggcttcattaagccgcagataggcagcaatggcaagatggtgcagggccgggtgaggcgctttcccggcgggcgaaagctggcgtccgccagcccggcagcagaggatcgggttttacagggttctgctggtcgccagcgccattaaacgcggataaaaaacaaaaaacagcgcttccagctgatcatagtgttgcgtgaaatcgtggtaggagtcgcgcagggctgccaggcgtggacggcggctggccatgccgtgcagcacccgctccagccgcgcgggctgggcataatgctcaaaccagcgctcgcgccacatcaccgcgttgagttcctgaaactcgatgggggtgtctgccagttgcggcatgatctcgcgctcggcggcggcagaaaagtgcaccagcgtctggccgggcgtgaagtgctgccagtgccgggccagaaaatggtcccagatgacgtccagcgtaatgggtgccacgcgataggtttcggcacggaacagctgacgggcgctgcgcacttccggcagcgcatcggtcatcacatcgagacgacggtgcatcagaatgccgtccgcgacgggcgcagaccagtgctggtgcgggttgccacgcacaaaatcggccattaaattgccgagtaaggagctgtcggccagcttagccagatggagatgagcaagaaagttcatgccgcattataggctgaactgcctttgcgcagccagttgttcagaattggtcgattttccgctaaactgtgccgcctgtttttgcctgagaaagaactctttcatgcgtgtcgccgattttgcttttgaactgcccgaatccctgattgctcactatccccaggcgcagcgcagcggctgtcgtctgctgtcgcttgatggtcccagcggagcgctgtcgcacggtgtgttcaccgacgtgctggataagctgaatccgggcgatctgctggtgttcaacaacacccgtgtgattccggcgcgcgtctttggccgcaaagccagtggcggcaaaatcgagatgctggtggagcggatgcttgacgacaagcgtgtgctggcccatgtgcgcgcctcgaaagcgccgaagccgggagcagaaactgctgctgggcgaagacgagagcgtcaaagcgacgatggtggcgcgtcacgatgcgctgtttgagattgtgtttgatgatgagcgcgcggtgctcgacatcctcaacagcgtcggccatatgcctctgccgccttatatcgaccgtccggatgaagaggcggatcgcgagctctatcagacggtttacagtgcccgaccgggtgccgttgcggcaccgaccgccggtctgcattttgatgaaccgctgctgcaggcgctgaaagagaagggcattgagatggcgtttgtgacgctgcatgtcggtgcaggaaccttccagccggtgcgcgtcgacaccatcgaagagcatcacatgcatgctgaatatgccgaagtgccgcaggaggttgttgatgcggtgctggcctgtaaagcacgcggcaataaagtagtcgctgtcggcaccacctctgtccgttcgctggagagcgccgccaaagcgagtcaggatgccctgattgcgccgttcttcgacgatacccagatttttatctatccgggctatgagtatcaggtgatcgatgcgctgatcaccaacttccatctgcccgaatcgactctgattatgctggtctcggcgtttgccggttatcagcacaccatggccgcgtaccgcgcagccgtggctgagcaatatcgtttcttcagttatggcgacgcgatgtttatcagcaaaaatccgcaggcgccgctggaaaaagtgggcgactgatttattaaccgatagccggaatcgactgagagcgactgaaggttatctgcatcggactgtttctccgatggaggctttgtgaaatttgaacttgataccacagacgggcgcgcacgccgtggccgtctgatttttgatcgcggtgtggtggaaacccctgcgtttatgcctgttggcacctatggcaccgttaaaggcatgacgccggaagaagtgcaggagaccggcgcgcagatcattctgggcaataccttccacctctggctgcgtccgggccaggagatcatgaaactgcatggcgatctgcatgactttatgcagtggaaagggccgatcctgaccgactccggcggcttccaggtcttcagcctgggcgacatccgtaaaatcaccgaagcgggcgtgcatttccgtaacccgatcaacggcgacccgatcttcctcgatccggaaaaatcgatggagattcagtatgacctcggttctgacatcgtgatgattttcgatgaatgtacgccctatccggcggactgggactacgccaaacgctctatggagatgtcgctgcgctgggcgcaacgcagtcgtgaccgttttgacagcctgggcaataaaaatgcgctatttggcattattcagggctcggtttacgaagatttacgagatgtctcggtgaaaggtctggtagagattggctttgatgggtacgctgtgggcggcctggcggtgggtgagcctaagcaggacatgcaccgtattcttgagcacgtctgtccgcagcttccgcaggataaaccgcgttatctgatgggtgtcggcaagccagaagatctggttgagggcgtccgtcgcggcgtcgatatgtttgactgcgtgatgccgacccgtaatgcccgaaatggtcatctgtttgtgactgagggtgtggtgaaaatccgcaacgccagatacaaagatgacactgcgccactggatgcggagtgtgattgttacacctgtcgcaattatagtcgtgcctacttgtatcatctcgaccgttgtaacgaaatactgggcgcgcgtctgaacactatccacaatttgcgctattaccagcgcctgatggcaggtttacgccaggccatcgaagagggtaaattagagcgctttgtaaacgagttctaccaacggacgggcaaagaagttccgcctttaacgtctgataattcatcaatgagggaaatttaatgagctttttcatttctgacgccgtggccgcagcaggcgcaccgtctcagggaagtccgtattctctggtgatcatgctggtggtgtttggtctgattttctatttcatgatcctgcgtccgcagcagaaacgtgcgaaagagcacaagaagctgatggattctatctctaagggtgatgaagtgctgaccagcggcggccttgtaggccgcgtaacaaaagtctctgacacgggctacgtagctatcgcgctgaatgacaccaatgaagtcgtcattaaacgtgatttcgtcgccgccgtgctgcctaaaggcactatcaaggcgctgtaattctttcttccctaagggaactgccgtgttaaatcgttatcctttgtggaagtacgtgatgctggtcgtcgtgattctcgtcggcctgctctatgcgcttcccaacctgtatggtgaggatccggccgttcaaatcactggtgcgcgcggaagcgccgccagtgagcagacgttggatcaaattcagtccgcattaaaacaagacaatatccagagcaaatctgttgcgctggaaaatggtgcgattaccgcgcgcttcaataatacggatgtgcagttacgcgcccgtgaagcgatcatgaaagcgttgggtgaaaactacgttgttgcgctgaacctcgcgccagccacgcctcgctggctgtcgatgctgtcagcagaaaaccgatgaaactcggtctcgatctgcgtggtggtgtgcacttcctgatggaagtggacatggacaccgcactcggcaaactgcaggagcagaatgctgactcgctgcgtagcgacctgcgcaccaaaagtatcccttacaccaccgtcaacaaaatcgcgaactacggcgtggaaattcgtttccgtgacgcagccagccgcgatgcggcgatctcctggctgacctcgcgtcatcaggatctggtgatcaacagcagcggcagcgatgccctgcgtgccaccatgagcgatgctcgtctcagcgaagcgcgtgaatatgcggttcagcagaacattactattctgcgtaaccgtgtgaaccagctgggcgtggccgaaccgctggtacagcgtcagggttccgatcgcatcgtagttgagttgccgggtattcaggatacggcacgcgctaaagagattctgggtgcaacggcgacgctggaattccgtctggtaaacaccagcgtggatccaaccgtagcggccagtggtcgtgtaccgggtgactctgaagttaaagacatgcgtgatggccagccggtggtgctctacaagcgggtgatcctgaccggtgaccatatcaccgactcgacttccagcatggatgagtacaaccagccacaggtgaacatttcactggatggcgcaggcggtaacatcatgtcgaacttcaccaaggacaacatcggcaagccgatggcgaccctgtttgtggagtacaaagacagcggtaagaaagatgccaatggccgttcaattctggtgaaacaggaagaggtgattaacgtcgccaacatccagtctcgtctggggaacagcttccgcatcaccggtatcaacaacccgaacgaagcgcgtcagctctcgctgctgctgcgtgccggtgcgttgattgcgcccatccagattgtggaagagcgtactatcgggccgaccatgggtcagcagaacattactcagggtctggaagcctgcctgtggggtctgcttgcgtcgatcctgtttatggtggtgttctacaagaagtttggtctgattgcgaccagcgcgctgctggttaacctggtgctgattgtcggcattatgtcgctgttgccgggcgcgaccctgaccatgccgggtattgccggtatcgtgttaacactggcggtggcggtggatgccaacgtgctgattaacgaacgtattaaagaagagctgcgtaacgggcgctcggttcagcaggcaattcatgagggctataaaggcgccttctccagtattgtcgatgcgaacgtgaccaccctgatcaaagttatcattctttatgcagtcggcaccggttcgatcaaaggctttgctattaccaccgcaattggtatcgcaacctcaatgttcaccgcgattgtcggtacccgtgccattgttaacctggtttacggtggcaaacgcatcaacaagctgtctatctgaggagtgcgttgtggcacaggaatataacattgagcagttgaaccacgggcgtaaagtcgtcgactttatgcgctgggataagctggccttcatcatttcgggactgctgattctcgccgcgattgctatcgtgggtgtgcgtggttttaactggggcctcgatttcaccggtggtacggtgattgagatcgcgctggaaaaaccggccgatcttgaagtcctgcgtggtgatctggtgaaagcgggctttgacgagccgctggtgcagaactttggcagcagccgtgacgtcatggtgcgtatggcaccggttaccggcccggcgggcaccgagttaggcaataaagtggtgtcggtcattaaccagaccacccagcagaatgctaccgttaagcgcattgagttcgtgggtccgagtgtgggcagcgacctggcgcaggcgggtgcgatggcgctgttgtccgcgctgattgcgattctgatctacatcggttttcgctttgagtggcgtctggcgctgggtaccgtgctggcgctggcgcatgacgtgatcatcacctgcggcctgctggcgctgttccgcattgaaatcgacctgacgattgttgcctcactgatgtcggtgattggctactcgcttaacgataaaatcgtggtgtcggaccgtattcgtgaaaacttccgcaagatccgtcgcggcagctcttacgatattactaacgtgtcactgacccagacgttaagccgtacgctgattacctcgctgaccacgctggcgatgatcctcatcctcttcgtgtttggtggtgcgctgctgaaaggcttctcactgaccatgctgattggtgtgacgattggtacgatttcatcaatttatgtctcttcggcgctggcgctgaagctgggcatgaagcgtgaacatatgctggtgcagaaagtcgagaaagagggcgccgatcagccttctatcctgccttaatcgccgcagagaaataaaaacgggcagccatgtggctgcccgtttttttttgcacctgtgatcagatcagggtgcagcaggggaggtctgggcaggtgcgtcgccggtgacgttatgcacgcggacataacctgattgatccggcgtgaggccgctgagtcgcagcggtatgctcaccgcatgctggggcaacagcgaggcaggcaccgctattgtctgactcagactgccgttactcagtggtttaccggttgccggatcgagttcgccccagttcaccgtagcgtgcagggcgggcaaagggcgatcgtccattgagcgtaccgtcagggttgcccgcgagccgctggcttcagcggtgacaggcgagagcgccagtcgcagcgtgccgagctgggtttgcagtgccaccggcgtgttcgcctgcgggatcagccacgcgccttgctgcgaatggctgtttaactgcccctgaatctccagcgcgctggcctgcgtggtcaggtgctgcatctgctgattaagctgactcacttcctgatgcaactctctgacctgcgggttgctggcgctactgctgcaaccgctcagcatcaccagagagagcgccaccggaacccaaaccatcctgctcataagttatccttgtccgttattttggaatacgtaaaacctggccaggatagatcttatcaggatgagagagcattggcttattcgcttcgaaaatcttgttgtattcgttggcatttccataaacctgtttggaaattgcgctcagcgtgtcgccttttttcacggtgtaaagttctgactcggccgcgctgtctgtcacggtcaccttatcttccactttggtgatgcctgcaacgttaccggctgcgatcagaatcttctctttcagctcctgggaaaggccatcgcccgtcacggtcacggtatcgccgttgaccttcacatccactttgtcgctgtcgggtaacccgagcttgttgatgtgatcctgcagctttttattctggtcatcgccgccattcacggcatcccataatttttcaccggcttctttcacaaaattaaacagacccatacaacctccagtgtgttagtggatatacgccgtctttcggctctataagcgtagacccttttgccgtcgctgatatttaacatcatttatgctgtgcgtggtggcacaggaaaggcacggaagagattttgttgattcgcagttcgcgttacactgtctggcccatctctctcgcgtcaggaaacgtcatgcattgcccattctgctccgctgtggacaccaaagtgattgattctcgtctggttagtgaaggctcttcggtgcgccgccgccgccagtgtctgatgtgtcatgagcgttttaccaccttcgaggtggcggaaactggtgatgccacgcgtggtgaaaagcaatgacgtgcgcgaaccctttaatgaagacaaaatggccagcgggatgatgaaagcgcttgagaagcgtccggtcagcgccgatgcggttgaaagcgccgtaaaccatattaaaacccagctgcgtgccaccggtgaacgtgagattcccagtaagctgattggcaatctggtgatggatgagctgaagaagctcgataaagtcgcctacatccgctttgcctcggtttaccgcagctttgaagacattcgtgattttggcgaagagatcgcccggttacaggattaaaccatggatgaactttatatggcgcgtgcgctggaactggcgcgacgcggccgctttacgacgatgccgaaccccaatgtgggctgcgtgattgtgcgcgatggcgaggtggtcggtgagggctggcatcagcgcgccggtgaaccgcatgctgaagtccacgccctgcgcatggcgggtgagaaagcgcgtggcgcaaccgcctatgtcacgctggaaccctgcagccatcatggccgtacgccaccctgctgtgatgcgctgatcgccgctggcgttacccgtgtcgtggccgccatgcaggatccgaatccgcaggtggcggggcgcggactgcaccgtctgcatcaggcgggcattgaggtcagccacggtctgatgatgccggaagcggaggcgctgaatcgcggtttcctcaaacgcatgcgcactggcttcccctggatccagctcaagctgggtgcctcactggatggcagaacggcaatggccagcggcgaaagtcagtggataacctcgccggctgcccgtcgtgatgtgcagcgcctgcgtgcgcagagcgccgccattctcagcagcagcgccacggtgctggcggacgatccttccctgacggtacgctggtctgaacttaatgcggagagccaggcactgcttgatgagcagcaactgcgtcagccggtgcgggtgattatcgacagccagaatcgcgtgacgccgcagcatcggctcattgagcagccaggcgaaacctggctgatgcgtcatcagcccgatcagcagagctggcccgctgacgtgacgcaaatcgctgttccgctgcgcgaacagcagctggacctggtggcgatgatgatgctgctgggacagcgacagattaacagcgtctgggttgaagcgggcgcaacgctggccggtgccctgttgcaggccggactggtcgatgaactgattgtttatctggcgcctaagctgttaggtcatgaaggacgcgggctgtgtaagctgccgggactaagccagctggctgacgcacctgccttccgtttcagtgatgtccgccaggtcggtgacgatttacgcctgaccctgacaccacaataacacggtcggaaaagcgagagcacgccgcccaagagtatgatagaatccgcccccctgcgcggggccaaccaaacccctgaaaggataagtatgaaagttatcgaagctgctgttgcaacgcctgaggccaatgttgccatcgttatcgcgcgttttaacaacttcattaatgacagcctgctggatggcgcagttgatgccctgaaacgtatcggccaggtcaaagatgacaatatcaccgtagtctgggtgcctggtgcatacgaaactgcctctggcagcacgcgcgctggccaacaccggcaaatatgatgcgattatcgcactcggtacggttattcgtggtggcactgcgcacttcgaatatgtggcgggtgaagccagctccggtatcgccagcgttgccatgaacagcgagattcctgtcgcgtttggcgtgctgaccactgaaagcatcgagcaggccattgagcgtgccggcaccaaagcgggtaacaaaggtgctgaagcggctctgactgcgctcgaaatgatcaacgtattgaaagccattaaagcctgatttttgtaaggggaattttgtgaaacctgctgctcgtcgtcgcgcccgtgagtgcgctgttcaggcgctttactcctggcagttgtcgaataacgacattgccgatgtggaataccagtttctggcggaacaggacgtcaaagacgtcgacattacctacttccgcgaactgctgtccggtgtggcgaccaacagtgcgtatctggatggactgatgaagccctatctgtcgcgtcagctcgaagagctgggccaggtagaaaaagctatcctgcgcatctcgctgtatgagctgagcaaacgtaatgatgtgccttataaagtggccatcaacgaagggattgagctggcgaaagtcttcggtgccgaagacagtcataaatttgttaacggcgtgcttgataaagccggtccacaaattcgacccaatcgcaaataaacaaaaaggccggcttgccggccttttttcatgaagggttaagcggaacgcaattatgtcttgtggtgaatttgaactcatcgcacgctacttcaaccgcagaacacgcagccgccgtgatgtcgaactcggcatcggtgacgattgtgcgttacttagcgtgccggaaaaacagacgctggcgatcagcaccgataccctggtcgcgggtgtgcacttcttaagggatatccatcctgccgatctgggttacaaagccctggctgtgaatctcagcgaccttgctgccatgggcgccgaccctgcgtggctgacactggccttaacgctgccgcaggtcgatgagagctggctctctgccttcagcgaaagcctgtttgaactgctggaatattacgacatgcagctggtcggcggcgacaccacccgtggcccgctgagcctgacgctggcgattcacggtctggtgccgcagggccgtgccctgaaacgttcaggcgcgaagccgggtgactggatttacgtgaccggtacgctgggtgacagcgcggcgggcctggcgctgctgcagcatcactgccgcatcagcgatccggcggtgcatgaagcgctgattaaacgtcatctgcgtcctatgccgcgcattctgcagggccaggcgctgcgtttcgctggcctcctcagcggtggatctttccgacggcctgatttccgatctcggccatgtgctgaaagccagcggctgtggcgcacggcttaatctggatgcgttgcccctttcggctgcgctgcgcgatcatttcgaccctgagcaggtcctgcgctgggcgctgagtggcggagaagattacgaactctgctttacggtgcccgaggtcaatcgcggcgcgctcgatgtggcgctgggtcacctgggcgtgccctatacctgcatcgggcagatggcaccggagtcggaaggcttaacgctgctggataatggcaagcccgccacattccgtcataaagggtttgatcactttgatgctaaataacgacgtggcgaagagtcgcctgcggatgagcaatccctggcatctgctggcgaccggtttcggcagcggattaagcccggtcgtgcctggcaccatgggatcgctggcggccattccgttctggtggctgatgacctatctgccgcaggatctctattcgctggtggtgctggtcggtatctgcgttggcgtctatctctgccatcgcactgccaaagatatgggcgtacacgatcacggcagcattgtctgggatgagtttatcggcatgtggattacgctgatggcgattccggttaacagctggcagtgggttctgggtggctttgtgctgttccgtattcttgatatgtggaagccgtggccgattcgctggtttgaccgcaatgtgcatggcggcatgggcattatggtggatgacattattgctggcgtgatttccgctgccatgctgtatggctttggggtctggctggcgggttaactgccgggactcctcatacagcgacagaaggtgacgcccgggcagggcgtctcctttctctgattttattcgaatcctaccggctgatgcggctgatagacctcttccagcagcgcaacttcctcgtcactcagcgtgacatccaccgccttcaccagatcctcaaactgctcagcacgcgacgcaccaataatcggcgccgtaacggcaggcttgctcagcagccaggccagagccacctgcgcccgcgttacacctttaccttccgccacctgcgccagccgctctgcaatcacggcatcattctcttcggtattgtcatagagcgacgccatcactttgtcagaggcggaacgcgcggtattttccccccacgggcgggtcagcttaccgcgcgccagcggactccacggcagcacggcaatctgctcttgcaggcagagcggatgcatttcacgctcctcttcgcgctgaatcaggttgtactgatcctgcatgctgacaaagcgatgccagccctgttccgactgcatctgcaacgcctgggcaaactgactggcgtgcatcgacgaggcaccgatataacgtgctttgccagactgcacgacttcatgcagcgcttccagcgtctcttccagcggcgtctcataatcccagcggtgaatctgcagcaggtcgacatactccatgccgaggcgctgcaggctgtcatcaatggattgcagaatattcttgcgcgacaatccctgtgacagattggtcagcgggaaatagactttggtggcgaccacgatctcttcacggcgggcaaagtctttcagcgcccgacccaggatctcttcactgctgccatctgaatagctgttggcggtatcgaaaaagttgatccctgcgttcagcgcctgctggatcagcggacggctgctcgcttccggcagcgtccaggcatggttgccgcgcgtgggttcgccataagtcatgcagccaagacagagacgcgacacctgcagatcggtggtacccagttgaatcgttttcatggtggaggctcctgcgaaagtgcaaaggtcttagcatagcaggatgttgcgctccccgaggggagcgcagcgagaggaggttactgcgccagccagcgggcgatctgctgctgaatgccctccgcgtccagcagatagtcatgacgcacttcgtcctgcgtcccctgcgggatgaactcatcaggcagaccgatgttcagcaccggaacagccagacgtttcgccataacaaattcattgacgccactgccggcaccgcccttgatggcgccttcttccagcgtaatcagcgagtcgtgcgtggcggcgagctcggcgatcagcgcttcatccagcggcttcacaaagcgcatatcgaccagagtcgcattcagcgcttccgccgtggcggccgcttccggcaacagggtgccgaaattcagaatcgccagcttttcaccctgacgtttcaccacggctttacccagcggcaggctctgcagcggagccagtggcgtaccgacaccagtgccgcgcggatagcgcaccgcacatggaccatcctgatagtgatagccggtgtagagcatctgccgacactcattttcatcgctgggggtcatgatcaccatatccggcacgcagcgcagataggcgagatcaaacgcgccctggtgagtctgaccatccgcgccaacaataccaccgcgatcgatagcaaacaggaccggcagtttctggatggcgacgtcatggatcagctgatcgtaggcgcgctgcaggaaggtggagtagatagcaacaatcggtttatagccgccaatcgccataccggcagcgaaggtcacggcgtgctgctcggcaatcgccacatcgaaatattgtttcggaaattcgcgtgagaaggccaccatgccggagccttcgcgcattgctggcgtaatcgccatcagtttcggatcgtcggcggccatttcgcacagccagttaccgaagattttagagtagctcggcaggccttccgcgctttttggcagttcgccaatcgcaggatcaaatttaggcacggcgtgccaggcaatcggatcttcctctgccggggcgtagcctttacctttcttcgtcatgatatgcaggaaactgcggccctttcaggctgcgcatgttgctcagcgtattgaccagcgtcagcacatcgtgaccatctaccgggccgatataattaaagcccagctcttcaaaaagcgtacctggcacgaccatgcctttgagatgctcttcggtgcgtcttaccagctctttgatcggtggcaggctggtcagcacacgcttgctgccttcgcgcagtcgcgcataggttttacccgacaggatctgcgccagacggttattcagcgcgccgacgttttcggagatcgacatctcgttgtcgttgaggatcaccagcatgtccggcttgatatcaccggcatggttcatcgcttcaaacgccatgccagcggtgatggcgccatcgccaataatacaggcggtgcgacgaccctgaccttcacgttctgccgccgcggccatgccgagaccggcactgatggaggttgacgagtgaccgacgctcaatacgtcatattcactttcgccgcgccatggaaacgggtgtacgccatttttctgacgaatcgtaccgatgcgatcgcggcgaccggtcagaattttatggggataagcctgatgacccacatcccataccagatggtcgaagggggtgttatagacataatgcagcgcgaccgtcagttcgaccacgcccagacccgacgcaaaatggccgctggagcggcttacactgtctaacagatactgacgcagttcatcacagagcgcaggcaacttctctttcggcagggcgcgcagctcctgaaccgtgtttgccagcgccagtgtcgggtatttagcaatatcaaaactcatcagagactcattatggaagttatttgtcgcgttcaattatgaagctcgccagcgcctgcagtgctgtagtgttataagagtgcgcagcgagcatttctaacgtatcaagagcttcctgatacaaatcccgcgctttagcttgggcattttcaaggcctaacagtgaaggataggtgctttttcccagatgctgatcggcaccctggcgttttccgatcaccgctgtgtcaccgatcacatccagaatgtcgtcctgcacctgaaacgcgagaccaatggcctctgcatagcggtcgagcagcggcagggcttcccggccagcatcacccgccgttaaggcgcctaatcgtaccgctgaacggatcagcgcgccggttttatgacgatggatctgctccagctggtccagatccacagatttaccttccgccgctaaatcaagcgcctgtccgccacacatgccggccacgccgctggctttcgccagtttcagagagcatcatcagacgatattcagcgctgacaccgggcattgcttcgtcggccagaattgaaaaggccagcgtctgcagggcgtcgcccgccagaatcgcggtatcttcgccatatttaatgtgacaggttggctgcccgcgacgcagtgcatcatcgtccattgcggggagatcgtcatgaatcagagagtacgcatgaatgcattcaaccgcggcggcgggggcatccagactcgccgggtcggcgtggagcatttcgccggtagcgtagaccagaaaaggacgcaggcgtttaccgcctaataatgccccatactgcatggcattcaccagaggagaactctgaaaaggaagtggctctataaaacgcgtcagcgcggcattaacctgctgctgatacgcgtcgagtaatcgggcgaaatccattagctgttttccggcgtgaaagcagtgaggtcggcatctttatcatcgttcagcagaatacggacccgctgttcagcctgctgcagcgtctgctggccagtccgcgccagctgcacgccgcgctcaaattcgttcagggcttcttccagcggcagttcaccactttccagacggctgacaatctgctccagctgctgcaatgacgtttcaaagctggctggctgttcggcttttttcggcatatttcgtgtcgactcacggttgggacattatctcgcaatcggtcatggtagctgagaccctatgattagcaaaataatcaatgcggcggctgatgaagaagcagtcacctgacaaaggtgatatactcccgcgcctcggatgcggttgcgccttgcagcccgcaattttgtgattttaccagctaagtgctgcctgttttagcacttatttgcccaacgaagctgtgtcgccgccatgaagtttatcatcaagttatttcctgaaatcaccatcaagagtccgtcggtgcgtttgcgctttatcaagattcttgccagcaatatccgcaacgtcctgaaaaccgttagcgacgaaatcgccgttgtgcgtcactgggatcacattgaagtgcgttcgaaaaatccggtgctgcgggacattattcccgatgagctgacgcgcattccggggattcatcacgttttagcggttgaagatcgtgagtacaccgatattcatcacatctttgaacagactttagtgcagtatcgcgacagccttgaagggaagagcttctgcgtgcgtgttaagcgtcgtggtaagcatagcttcagttcacaggatgtggagcgctatgttggcggcggtctgaatcagcatattgaaagcgcccgcgtgcagcttaaaaacccggacgtgacggtgaatcttgaagttgaagagaatcgtctgacgctggtgactgcgcgctacgaaggtctgggcgggttcccgatcggcacgcaggaagatgtgctgtcactgatttccggtggctttgactccggcgtctccagctatatgctgctgcgtcgcggcagtcgcgtacattactgcttctttaatcttggcggtgccgcccatgagattggcgtccgtcaggttgcgcactatctgtggaatcgttttggtcgttcacaccgcgtgcggtttcgtggcgatcaattttgagccggtagtgggtgagatcctcgaaaaagtggatgacggtcagatgggtgtggtgctgaagcgcatgatggtgcgtgccgcctcgtcgattgctgagcgctacggcgtgcaggcgctggttaccggtgaagcggtgggtcaggtgtcgagccagacgctgaccaacctgcgcctgattgataacgcctctgatacgctgattctgcgtcccctgatctctcatgacaaagagcacatcatcaggattgcccgtgagattggcaccgaagatttcgccagcaccatgccggaatattgcggtgtcatctcaaaaagcccgaccgtgaaagcggtgaaagagaagatcgaggctgaagagcagaatttcgacttcacgattctggatcgggtcattgaagaggcgaccaacgtcgatatccgtaccatcgctgagcagacagaagaggaggtggttgaagttgagaccgtcgccatgctgagcgagaacgacgtggtgctggatatccgctctattgatgagcaggaagagaagcctctggcactgaaagctacggaggtgaaatcgctgccattctacaaactcagtacgcagtttggcgatctcgatcagaaccggacctggttgctctactgcgatcgtggtgtgatgagccgtctgcaggcactctatctgcatgagcagggctttaaaaacgtgaaagtctaccgcccgtagtgacgcctcagagccagtcagcgcctgttcaggtctgactggctgcattgccttaaacagagcgttttaactcagcgtgtttacgcctgatagtcataaatgccgggagccagcaccagctgtgcggccacctcgcgcgccatctcttttcccaccagcagatcgatcagctttagcgcaaaatccattgccgtgcctggcccctggctggtcagcagattgacgcgcggatcccagaccacacgccgctccatccacttgtctgacggaatggtctcttttaagccgggaaagccagtcatgttaccgaccggaaagagatcgtgggggatgagtactgtgcctgccgctgcgcagatagcggcgacgatcctttcattgaggtgaaactggcgtaccgtttcgactaacagcggactgtcacggaaggtttcggcgcctttcaggccgccgggcaggacgatggcggcgaaatcattgtcggcgacttcaaccagcgtcacgtcagccagcagacgaacaccgcgtgagcagacgatctcccggttgccgtcgctttcgacgctggcggtgacgacgttcagcccggcccgtaccagcaggtcgatagtggtgacagcttcggtttcttcactgccatgtgccaggcaaaccagcactgatgcgttcgcggtcataatgggactccttgcgttttacaatgtcatacagacgggtgttctccgtcagcaccatgccgtgcgtccgggcgcggcgcagcagaaaaccgctgatatagtcgatttcggtaagacgctgggcgcgtatgtcctgcagcatcgaagaggtgttggccgcggtgctttcaatcacgtcgaagatgatgtcctgcaggctttcgctggcaacgttctgaccttcgcgctccatgacccagctgatctcttcgcacagttgcgcgatctgctccggataagcgcgcagggcaccgtttctggcactcatactccacgctaagcggattgatgatgcagttcactgccagcttgcgccagcaggccgcccggatgttgtcatgccaggcgacatcaggcagggcatgatgcaggatatcggcgagatcgctgtaagcggcgcttttacggttaccggggccgatgtgggtgatgccactggcaatgtgtttgatgacggtgccatcgcgcatcgccgcatgggttgttaccccacgcagtagcggctgagtcagccctttcagctcttccagcgtccccatgccgttgtgcagcagcagcaccgggcagttttctggcagcacgctttccaggtttttcaccgcgggcgagacctgcggggctttgagcgtaaccagcagcagctggctttctgccagaaacagcggatcgttggcgataaacgtgcggttcgaaatgttaccctgtggatcaatcacattggctgaacagtagggctgcggcacccgcaaccatccctgcacctcatgtccctggcgggcaagggctgtcatccagatctgacccagagcaccgcaacctaacacggtaattttcatgctgcctcccgctggcgggctatccatctattatttactgtcacactttcattatagcgttgtgtgcagcctgattttatttagcaccttaagacgcgtattatgcatgtcactttagcgtcaggagaagaagagatgccatctttcgatatcgtttcagaagtcgatctgcaggaaattcgcaatgcggtggaaaatgccaaccgtgaagtgtctacccgcttcgatttccgcaacgtgagcgccgagtttgagctcaacgaaaagaatgaaaccatcaaaatcaccagcgagtccgattttcaggttaagcagctggtggatattttgcgtgagaagttactgaagcgcgggattgaaggcggtgctttagaggtgccggaagagattgagcacagcggcaaaagctgggcggtcgatgccaaactgaaaaaaggcattgaaagcgacgtggcgaagaagctggtgaagctgatcaaagacagcaagctgaaagtgcagacccagattcagggtgaagcattgcgtgtaaccggcaaagcgcgtgatgatttgcagggtgcgatggcaatcgtgcgcggcagcaatctggggcagccattccagtttaaaaacttccgcgattaagcgggggccggctgaatttcagcatgaatgcagtgataaaaacccggctaaggccgggttttttgttgttgagcgagaggtcgtctggatgatagcgttctggctcaggcacccatcgccttggatttatgagtcgtctgtaagaaggcttgtgccgggtttggcgcggttgagcctattctggccccccttgctttgagtttataagctgtctgaaaccaggattgagttggatttgagtctgttaacagattcaaatcctgggggaacttagcagcaactcaaaagctcaggggcgcagggggcacggtcagaggaggaaagcgtcccgcgccagggacggcgcgggccgagcgtgccatggatggcggcttttgcgactttccgatctgaccgtgttccctgagccagctcgatcctgaagcgaaacgagctgacgttatcactaaactttttaagctaacaactacccagcagagcttccagctcagggcggctggtaaccttgctatcaattttgatgtaggcgcttttctcttctggcacgataaacacagagttaacgcccggctgcgctttcaggcgctgctccagattcggcacggccagtgcggcatcactcagcacgatgcgcaggctgctgacataaggcggttcctgcattgtcatgctgacaaacagccaggctgcggccaccatcgcgccaaccaggaatacggtctgcgcatcgaaatgaccaaatacccagccacccatgctgccgccaacggccacgcccaggaaactggctggtggagtagatccccatcgccgtgcctttgtagcccgcaggcgactctttactgatcagcgaaggcagaatcgcttccatcaggttgaaagcgaagaagaagagctgaacacccaccaccagcgtccagaaatgtccttccgcgccccacaatacgatctcggcaatgacaatcatcccgacgcagccgacaaagacacgcttcatgcggcgcttcacttcggcataaatgatgaaaggtactacgccggcaaaagcgatcagcatggtggagagatagactttccagtgttcgggagccgggaagcctgcctgttcaaactgccccggtaacgcgacaaaactcgacatcagcaggacgtgcaggcagaaaataccgatattgagcttcaccagacgtgggttagccagcactttgcggaagctgcctttaaccatgcctgattcacggttcagaacatgatgggaggccgatggcaccaccagcagagtgatcacgatacccagcgacgccagaatcgcaatcatccagaacagcgcatgcaggcccagtgcgtgagtaacaatcgggccgaccaccatggcgatcgcgaaggtaacgccaaaactgatgccgataaacgccatcgctttggtgcggttctgctcacgggttaaatcggataacagcgccatcacggcagcggcaatcgcgcctgagccctgaagtgcacggcccagaataatgccccagatggagtcggtgcaggcagcaataatactgcccaggacaaacagcaacagtccgccaacgatcagcggcttacgcccgatgcgatcggagagcagaccaaaaggaatctgaaatatcgcctgggcaaggccataaatgccgattgccaggccaattaaggtttcactcgcgccctgtaatgccatgccataagtggtcagtaccggcaggaccataaacattcccagcatgcgcagggaaaagaccgtaccgaggccccatgtggcgcgcagctccaccggagtcattttattatcgttcattccaacctctgttaatgtgctgcatttattctagggggcggggcagggcgggtaaaacaatagtttttaagcagtggtaacaaaaagaaagggcgcgaaaatcgcgcccttttcatgctgtatcggtgccggttaccagacgtaagtcagcaggtccttcgaggccggagccatcgaatccaccgacatcatcacgctcagtgcggtgatggtcacgatagagaagacaaacagtttacgcgcccagacacggtcatcagcggttttataacccgataacgccatgcccagccaccagacgctgaccgcagcagccaccaccagatatttgtagcccgcgtagcctcccagcgtcagcatcagcgtggcaatcataaacgccaggatatagagcgtaatatgatttttagccacggaaatgcctttcaccaccggcagaaaccgggatgttcgctgcctggtaatctttaaagcggaagatggcaatcgcgtacgaatgcggcatctgccacaggctaaagatcgccagcaggattaatgcgccagcatcaaactggttagagaccgcgcagtagccgataaccggcggcgcagcacccgacagactgccaatcagcgtaccgtaaacggaattacgcttcatgtagagactgtagatgcccacgtacaccacgaagcccatcaccgccagccacatggccagcggattagcaccgaagtagagcaacgcaaagccagcaatacccagcacagtggcataaaccaggcttactttcgcggagatgaggccttttaccagcacccgattcctggttctctccatcttgatgtcaatgtcgcggtcgatcacgttgttaaacacacaacccgatgcaaccaccagtgacacgcccaccagggtgatgagaaacagggcgtaatccgtgttgcctttggaagccaacagaaatccgccgatcacagaaattaaattcccgaaaataattcctggttttgtaacttgcaggtattgcttaaacattacgcgtgactctttagtgaggcatcatgttgtagttgaggttccacatgatccacagtgagcctactacgacaatcaggatgatgatggccgagaagacaatggctaccatgttccagccaccctcagatttgctgtctaagtgcaggaagtagaccaggtgaaccagcacctgaatcaccgcacataccagaacaacaccaaggatagtaccgtgagatgcactgccatccattaccatccagaacgggatcgccgtcaggatgatagagaggatgaagccgatcatgtaggacttcacgctaccgtgtgaagcgccatgttcgttaacagaatgactcattacatggctcccatcaggtaaacaacggtgaagacgcaaatccagaccacgtccaggaagtgccagaaacaggctcagacacatgatacgagtgcggttagtcgcgttcaggccacgtttggaaatctggaacatcagaaccagcatccagatcagacctgaggtcacgtgcagaccgtgggtaccgaccagcgtaaagaagccagacaggaagccactgcgatccggaccaaagccttcagcaatcagatgatggaattcatagatttccattccgatgaagcccagaccgaacaggaaggtcagcgccagccagccgataacggcacctttttgctccttgttcatggagataacagccatgccgtaagtgatcgaactcaacagcagcagggcggtttctaccagaacaaacggcagctcaaagatatctttacctgccgggccaccggcagtgttgttgaccatgacagcataggtcgcaaacagggttgcgaagataatgcagtcactcatcaggtagatccagaagccaaagactttattggctcctgcatcgtgatgcccatgctccgcatgggcgtcgtggtgatgtttaatcagagtttcagttgacattatttcagacctgctttgctgatttcgtcaaagtgctggttctcaatcttctgaacttcggcaaccggaacgtagtaatccacgtcttcgtcgaagctcttcacgatccaggaaacgatcatgccgaggaatgaaacacccgccagccaccagatatgccagatcagcgcgaaacccattaccgttgcaaatgcgcagatgataattgcggcaccgctgtttttcggcatatgaatctcttcatacgattccggctgtttgtacgcttcgcctttctctttcatttcccagaaagcgtcacgctcatgcacatgcgggatgacagcaaagttatagaacggtggtggtgaagaggttgcccactccagcgtacgaccgccccatgggtcacccgtcacatcacggttctgatcgcggtcacgtaccgagacgtagaacatggtcagctgacacagaatacccagcgcaatcaggccagcaccgcccgcagctaccaccagtaaggtgtggaactgtggatcgatatcctggctcagacgacgcgtcatacccatgaagcccagtgcgtacagcggcataaaggcaacgaagaagccaatgatccagaaccagaatgcgcgcttgccccaggtttcgttcagggtgaagccaaatgctttcgggaaccagtaggtcacgcccgccatacaaccgaacaccacaccaccgatgataacgttatggaagtgtgcaatcaggaaacaggctgttgtgcagaataaagtcagcacccggaacggccagcagtacgccggtcataccccctacagagaaggttaccaggaagccaacggtccacagcatggcagagtgcatctgaatgcggccctgatacatggtgaacagccagttaaagattttaacccctgtcggaatcgcgatgatcatcgtcatgataccgaagaaggcgttaacgttggcacctgcacccatggtgaagaagtggtgcaaccagacgataaacgacagcacggtaatggcgatggtcgcccacaccagtgaggtataaccaaacagacgttttttggagaaggtcgcggtaatttctgcgaacacaccaaacaccggcagtaccaggatatacacttccggatggccccagacccagatcaggttgacgtacatcatcatgttcccgcccatttcattggtgaagaaatggaagccgagataacgatcaagggtcaacagcgccagggtcacggtcagaaccgggaacgcagcgatgatcaggacgttggtgcacagcgcggtccaggtaaataccggcattttgaacaggctcatgcccggtgcacgcatcttcaggatggtcacgaagaagttaataccggttaaggtcgtaccaatacctgaaagctgaaggctccagatccagtaatcgaccccgaccccgggactgtactccgcgccggagagcggcggataagccagccagccggtctgtgcgaactcgcccacacccagagacaggttaaccaggatcacaccgaccgcagtaaaccagaagctcaggttgttcaggaacgggaacgcaacgtcacgtgcaccaatctgcaacggaaaccgcgatgttcatcaggccaaccacgaacggcatcgccacgaagaagatcataatcacgccatgcgcggtaaagatctggtcgtagtggtgcggtggcagaatgcccgcttcaccggccgaagccataacctgctgggtacgcatcataatggcatcagcgaaaccacgaatcagcatgacgaacgccatgatgatgtacatgatacccaggcgtttgtggtcgactgacgtcagccattcagaccacagatatttccacttaccaaaataggtgagcgcagcaaccagcgctgcaccacctatcaggatagcggcaaccgtaaccatgataatcggctcatggtacggcactgcatcaagtgttaattttccgaacatcgtattattcctcggctcccgcggaagcggcgtgactcatgtccataccttcatgttttggcatgtccattttcccgtggctcatcttgaacttgtcgatgacttgcatgaacagtttcggatcagctgaagagaaatattccaccgggtgattttcgcttggcacagccactttctcgaaatcatccatggtgttcagcgtgttaggggctgctttaactttagccacccactgctggaattccgcatcgtctttggttgcaatggctttaaacttcatgccagagaaaccacgaccactgaagttcgcagagataccgtcgaaaattcccggctcatttgcaatcagatgcagcttggtctgcataccagccatcgcataaatctggctgccgagcgttgggatgaagaaagagttcatgacggagttagacgtgattttgaagttcaccggagtatttgccgggaaggcaatctggttcacggtcgcaataccctgttccgggtaaatgaacaaccatttccagtccagtgcaaccacatcgatctcaaccggtttcacatcagattgcagcggtttgctgggctccagtgcgtgggttgatttccaggtcagcacgctgaggaagagaatgatcaggatcggaatggtccagaccacggcttccactttgttagagtgtgaccagttagggctgtacttcgcattcgtgttggacgcccgatatttccaggcaaacaccacggccatcaggactgcggggatgacgacgatcaacatcaggccaaaggcagtcagtatcagcgaacgttgctccagtgcaatctgtcctttgggatttaacaatgcactatcgcagccactcattaataaagtgcctgcaattaatgacaaaatccccaaacttttattgtatttactgagtctcatttaacgacctcaatgacaaagggctctattgtcgtttaagtgtgcgcgcattttacgggaaggtttatgcagtgtaaaccagcttaaggatgtgtcagatacgtgttgacaccttttgctaagggtgtcacagatgttgcgccaggtgacaaataattaacgcagacaagcagttggcatcaatataacaaaaaccaatggaagtaaccgtaaaaaaatcagggaaaggaataacccttacttttaactcccaaatatttaacaagtctgcatcatttgcgcgatgaaatttaactaaagtaattgctcaccggtttttagtatttccgctacgcctcctcaggtcatattgttatttttaaaaaataacacgcgatgataaatggcggcgacttatcggggtgtcataaaataagccgcagcccgtaaacctatcgatttcacttaagcatctgatgcaggcaacgcaggggttctcttcagcgcccgatagtccagcaacacccccgaaagcacggccagcaaggagagtgtcatacccagctcaaacaggcgggtaagcagcggtgtcagcgccgtcacgcccaacgcattcagtgccagagccaccagccagagcgccagtacgccgcatccggctgcaaacagacgattagtccagcgatagccatgaggatagtagctacgtgtcagaaaattgccactttgctcgacctgattcaatgtttgtcggcaaaaagccagcagcaccaggcccggcagacccgccatcaccgtgaatgcataaaaggtcggccagccccagagttccaccagccagcccgccgccgggcccacatagacccgacccaccgctgagagcgccgacaacagggcgaactgggtagcggagaacgacttattgcacagcgtcattaacagcgccacaaaggccgcggtgcccatgccgccacagagattttcaacaaagaccgcgctggccatgctccacaactgtttgtcggtcaccgccagcagccagtaaccaaagttcgagacagcctgcagcagaccgaaaatcattagcgcccggaacaggctcagacgctgcatcagtacgccgccatagagcgccccgataatggtcgccagcagacccagcgtcttgttgaccagaccgacgtcaccggcgttgaagcccacgccgcgaatcaaaaaagtggtagtcagcgaggcggcaaacgcatcgcccagcttgtaaagaataatcagggtaatcagcagccaggcgttgttgcgctgaaagaaatcttttagcggatcgaccaccgcctgacgcagtgaatggggtgtggagatacgggtatctggctcgctcgccaccagcgtggcgataatgcccggcaccatcatcagcgccatcagccagtaggttgcctgccagccgaggtagcggtcagccagccacaacgccagcccgccggaaatcagcattgccagtcgataccccagcacggtaatcgccgcgccgctgccacgctcttcaggcggcaggatgtccgttttccatgcgtcaaaaacgatgtcctgtgaggcggagcagaaggcaatcagcacggccagcgcggccatcagggtaagatcgcgtcccggttgcagaaatcccatcgcgattatcccgccaaccagcgccagctgactgaccagtaaccagccgcgacgtcggcccagaaacggcggcgtatagcggtccatcatcggtgaccagagaaacttaaagacataggcctggccgaccagcgaaaagaagccgatggttttcaggtcgacattttccaccgtcatccacgcctgcaacgtgcccgatgtcagggccagcggcagtccggaagcaaaaccaagaagcagcaatacggcggcgtttttctggctgaagaggcgaagatagtggttcatgcggatcctgcagataacaagaagccctgcgcaaggcagggcagaggagagactgaattaacgggcgtttctgcttgatgaagtcgttgacgctggtgtcctgagccatatccgcgatcacatcgctcatagtggcgttcaccgcgttggtaatcttctggttattggcgttgaacgcgccttctacgctgtaagtctggcggtagtttttaacctgtttgttgccgtttttcgctgttgcgataatagagatgtccgctttggtggtgatgctgtagcgcacattgccctgagtgacgtcggcatagaggttgttcaccacaatctgcagatcgaccgcgccattaggaccaatcatatagccgcgtgctgtcatctgcttctccagcacttcctgcagcaggaagcgcaggtcacgcgatgacgttaaggtcactaactgaccatcacggtttacttttgccagcgcctgatctttacgctggtcggcaccgttgatgctgacagtcacgcccatcaggcctgggtcctgctgcggtaactgaattttaggctggatagtcagggtgttattgctggttgcacagccggctaaaatgaacgcagccaacagtgggaataacagttttttcaacatactttttctcgttggtgtcagggggttggtttgcaaaaactgcggtcatcatagcattgcccggcagtgaaaaaagccctgttgccggggaaattgtgtctgaaaccgttttaagccccttctctgacaggtcggtttgctgttcgtttcagctgcgttattatgcgtgccggaagcggtctgacataaaatgcaatatttagcgtgcgcttgcgggtaagcgcactaaaagcgactaagattgaatgagatggggcactgcgctcgccattgaggagtaatagccatgatccgcgaacaaatagaagaaaagctgcgtgtggcgtttcagccagctcatctggaagtgcacgacgaaagttaccggcacaatgttcctgccggatcggaaagtcacttcaaagtggtcatcgtgagcgactgctttgcaggccagcgctttctggcgcgtcatcgcctgatttatggcgaactggccgctgagttagcgggcagcgtacacgccttagccctgcatacttacaccctgaaagagtgggaagggttgcaggataccgtactggcttcgcctaactgtcgtggtgccggaacactcgcctgatctcccttctctgaaacggcctgcgggccgttttttctgttatttagcgaaaaacgcgatccctggctcaaaaaagcagcaaacctgctgaaaagtggtgagttagcatcctcgactcattccagcgatgccgctataatgctgcgtctatttttccggaatgtcttcgggacgcttctggtaacagggatcaggttctcttcacggaagccgtcccggttgttggatacggcgcatttcactatgtgtggtgtctgaagttgaccgagcacgtgattttttgaggtaacaagatgcaagtttctgtagaaaccactcagggcctgggccgtcgcattacgattactgtcgctgctgacagcatcgaaagcgctgtaaaaaaagaactggttgacgttgccaggaaagttcgcatcgatggtttccgtaaaggcaaagtgccgatgaacatcgtggcacagcgttacggcgcttctgtccgtcaggacgtgctgggcgagctgatgacgcgcaactttgttgacgccatcatcaaagaaaaaattaatccggctggcgcaccgaaactacgtgccaggcgaatacaaagaaggtcaggatttcacctacgcggttgaattcgaagtctatccggaagttgagctgaaaggcctggaaaacatcgaagtcgaaaaacctgtcgttgaagtaactgatgctgacgttgataccatgctggacaccctgcgcaagcagcaggccaactggatcgaaagcgacgctgcagcaggtccggaagatcgtgccactatcgatttcaacggttctgtggatggtgaagagttcgaaggcggcaaagcctctgatttcgttctggccatgggccagggccgcatgatcccaggctttgaagaaggcgttgtgggtcacaaagcgggcgaaactttcactatcgacgtgaaattcccggacgactaccacgcagaaaacctgaaagggaaagatgcgaagttcgagatcgtgctgaagaaagttgaaacgcgcgaactgccagagctgactgaagagttcatcaaacgtttcggcgttgaagatggttcagttgccggtctgcgtactgaagtacgtaagaacatggatcgcgagctgaaaggcgctatccgtaatcgcatcaaaactcaggcaatcgacggtctggttgaagcgaacgaaatcgacgtgccagctgcgctggttgacagcgaaatcgacgttctgcgtcgtcaggctgcacagcgtttcggtggcaacgaacagcaggcgctggaactgccacgcgaactgttcgaagagcaggctaaacgccgtgttgttgtcggtcttctgctaggcgaagtgattcgtacccacgagctgaaagctgacgaagcgcgcgtaagcaccatgatcgaagagatggcttctgcgtatgaagatccgcaggaagtgatcgagttctacagcaagaataacgagctgatgaacaatatgcgcaacgttgcgctggaagagcaagcggttgaagcggtcctggcgaaagctaaagtgaccgagaaagagaccaacttccaggatctgatgaatcagaccgctcaggcctgatcacgcatttaaccgtctgtgctaagcccgtgactgcaaagtcgcgggcttttttgtgttttgcgtccggatagccactcttcgccgctatttgtttaataaacaggcgaattattcacgcatcgctttttccgggttagcgaacagggaaaagattgttatgcttgaaacatgcgtgcagcatccccagatacagggagtatgcagaaataagagtgaggctggctgattaaccgtcctgaaggtgtcggaaaaaggcgcggcgtggagtttcccgcgcgtcttacgtagaatcggtacagaatgttgccaatgaaatttatccaggagacggtaatgtcatacagtggcgatcgtgaatatacagcaccgcacaatgcgctggtgccaatggtggttgaacaaacttcgcgtggtgagcgtttcttacgacatctactcccgtctgcttaaagagcgcgtcatttttctgactggccaggtcgaagaccacatggctaatctgattgtggcgcagatgctgtttctggaagctgaaaacccggaaaaagatatctatctctacattaactcgccaggcggtgtcatcactgccggtatgtcgatctacgacaccatgaaatttatcaaaccggatgtcagcactatctgtatgggtcaggcctgttctatgggcgctttcctgctgacggcggggaccaaaggcaaacgtttctgtctgccaaactcacgtgtgatgatccaccagccgctgggcggttatcagggtcaggcgtcagacatcgagatccatgcgcgcgaaatccttaaagttaagcagcgtatgaatgagctgatggctgagcacaccggtaaaacgctggaagaaattgagcgtgacaccgagcgtgaccgtttcctctctgcaaatgaagcggtagagtatggattagtcgattcaattctgacgcatcgccaataagacccgacttaccgttgtccctggtctatagttaacaggacaacggtactattatgggttgaatgaatttcggccgtctccgcacggcctgagccgtacgcgggtatggcctgagaacaagaagaggttaactgatgacagataagcgcaaagacggttcaggaaagttgctgtactgctctttttgcggcaaaagccagcatgaagtgcgaaagctgattgccgggccgtcagtgtatatctgcgatgagtgtgttgacctgtgcaacgacatcattcgcgaagagattaaggaagttgccccgcatcgtgaacgtagtgcgttgccaaccccacatgaaattcgccatcacctcgatgattatgtcatcggtcaggaaagagcgaagaaagtgctggcggttgcggtttacaaccactacaagcgtctgcgcaacggcgataccagcaatggtatcgagctgggcaaaagcaacattctgctgattggcccgaccggtagtggtaaaacgctgctggcagaaacgctggcacgcctgctggatgtgccgtttaccatggctgatgccaccacgctgactgaagccggttacgtgggtgaagatgttgaaaacatcatccagaaactgctgcagaaatgcgactacgacgtacagaaagcacagcgcggcatcgtttacatcgatgaaatcgacaaaatctcacgtaagtctgataacccgtcgattacccgtgacgtgtcaggcgaaggcgtacagcaggcactgcttaaactgattgaaggcaccgtggctgccgttcccccgcagggtggacgtaagcatccgcagcaggaatttttgcaggttgatacctctaaaattctgtttatctgcggcggcgcatttgccggcctggacaaagtgatcgcccagcgtgttgaaaccggatccggtatcggcttcggcgcgaccgtgaaagggaaatcgcagaaagccagcgaaggcgaactgcttgcgcagtgtgaaccagaagatttgatcaaatttggtctgatccctgagttcatcggtcgtctgcctgttgttgcgaccctgagcgagctgagcgaagaagcgctgattcagattctgcgtgagccgaagaacgccctgaccaaacagtaccaggcgctgtttaacctggaaggcgttgagctggagtttccgtgacgaggcgttaaccgccattgctaagaaagcgatgtcacgtaaaaccggtgcacgtggtctgcgttcaattgtagaaggcgcgttactggaaacgatgtatgacctgccttccatggacgacgtggaaaaagtagtgattgatgaatcagttattgaaggtcagtctgagcccatgttgatctatggtaagcatgaagcccaggcatctggcgaataattaaacagatcgtccatcttgtcgtaataaaaaaggggaaaatgtttccccttttgcttttctcgcctctgtgacgttgaatgtcggacaatcatccccatatactcagatacctgtgggtttaactgcatacctgcctgatgcggttcccatcacctggcggacattaaacaaagagagagctctatgaatcctgagcgttctgaacgcattgaaatccccgtgttgccgctgcgcgacgtggtggtttatccgcacatggtaattccgttgtttgttggccgggaaaaatcaattcggtgccttgaagccgcaatggatcatgataaaaaaatcatgctggtcgcacagaaagaggcttcaacggatgaacctggcattaacgatctcttctcagtagggaccgttgcatcagtattacaaatgctgaaactgccggatggcaccgtcaaagtcctggtcgaaggtttacagcgcgcccacattacgacgctggccgataacggtgaccattttgtggcacaagctgaatatctggtttcgccagagattgaagagcgcgagcaggaagtgctggtgcgcacggcgatcaatcagtttgaaggctacatcaaactcaacaaaaagatcccacccgaggttttaacctcgctgaacaacattgacgatgcggcccgccttgccgacaccgtcgcagcacatatgccactgaagctggcagacaaacagtctgtgctggagatgtccgacgtcaacgaaacgtctggaatatctgatggcgatgatggaatctgaaatcgatctgctgcaggttgagaagcgcattcgcaaccgtgttaagaagcagatggagaagagccagcgcgagtactatctgaatgagcagatgaaggcgattcagaaagagctgggcgagatggacgacgcgcccgacgagtacgaagcgttaaaacgcaaaatcgacgcggcaaaaatgccggaagaagcgcgcgagaaagcggaagctgagctgcagaagctgaagatgatgtccccgatgtccgctgaagcaaccgtggttcgcggctatatcgactggatggtgcaggttccgtggaacgcgcgcagcaaagtgaagaaagatctgcgtaaagcgcaggagacgctggataccgaccattacgggctggagcgcgtgaaggatcgtattcttgagtatcttgcggttcagagtcgcgtcagcaaaatcaaagggccgattctgtgcctggtcggaccgccaggggtaggtaaaacctctctcggtcagtcgatcgccaaagcgaccggacgcaaatatgtgcgtatggcgctgggtggcgtgcgtgatgaagctgaaatccgcggtcaccgtcgtacttacatcggctctatgccgggtaaattaatccagaaaatggcgaaagtcggggttaaaaacccactgttcctgctggatgaaatcgacaaaatgtcctctgacatgcgcggcgatccggcttcagcgctgctggaagtgcttgatcctgagcagaacattgcgttcaacgaccactatctggaagtcgactatgacctctctgatgtgatgttcgttgccacatctaactcaatgaacatcccggcaccgctgctggaccgtatggaagtgattcgtctgtcgggttacaccgaagatgaaaaactgaacatcgctaagcagcatctgctgaccaagcagattgagcgcaacgccctgaaagccaatgaaattacggttgaagacagcgcgattgtgggcattatccgttactacacccgtgaagccggtgtgcgtagccttgagcgtgagctgtcgaaattgtgccgtaaagcggtgaaatcactgctgatggacaagacgaaaaagcacatcaacatcaatggcgaaaacctcaaggatttcctgggcgttcagcgcttcgactacggtcgtgcggacagcgaaaaccgtgtgggtcaggtaacgggtctggcgtggacggaagtgggtggcgatttgctgactatcgaaaccgcctgcgtaccaggtaaaggcaagctgacttacaccggtttctctgggtgaagtgatgcaggagtcgattcaggctgcgctgaccgtggtgcgtgcgcgtgccgagaagctgggcatcaatggtgacttctacgaaaaacgtgatattcacgttcacgtacctgaaggcgctacgccgaaagatggtccaagtgccggtatcgccatgtgtactgcgctggtctcctgtctgaccggtaacccggtgcgggcggatgtggcgatgaccggtgagatcaccctgcgtggtcaggtgctgccaattggcgggctgaaagagaaactgctggcagcgcaccgtggtggcattaaaaccgtgctgatccctgatgacaacaagcgcgacctggaagagattccacagaacgtgattgccgatctggagattcatccggtgaaacgcattgaagaggtgctcaatctggcactggaaaatgcgccatacggtatgcaggttgtaacagcaaaatagtgattaacggcaaaaaccgttaaaaagcggagctggcaaggcaattggcgcttgccagcttttttttgtgccgttaatttaggtggctgccgacgcgacgttctcagagaaattccgttgtttcggctccacaggcttgatataacttgctgcgcgttcgcaccctgccggatgcagggtacgatgtgaaataataaaagaggggatgaagagagtgaataagtcacaattgatcgacaaaattgctgccgatgctgatatttctaaagctgcagcgggacgtgttttagatgcatttatgggctcagtttcagatgcgctgaaagacggtgatgaagtggctctggtaggtttcggcacattctctgtgcgtgaccgcgctgcacgtaccggccgcaacccgcaaaccggtaaagagatcaccatcccggccggtaaagtaccaggcttccgtgctggtaaagcattgaaagacgctgtcaattaataacaacgaatagattcattgacgcattttcttcagtggattagaggacgattaacccgtttctcatgtaacatacgggcacatcaatcagatgtgccttttttgttttaaccggtgagaatcgggccgtaagatggacctggaccggattgagactgccagctaagccagcagttgcgtgagtcgccagccaatggcgaattgcgaccgagctttacattcacactacagcggagtgttgccataccatgatggacaatttacgcgcggcgtcgaaccatgtcgtgctcaagattattttggggctgattatcctctcctttgtgctgacgggcgttggcaactatctgattggcggcaataacgactatgcggccaaagttaacggccaggagattagccggggacagctggagcaggcgttcaacagcgagcgcagtcgtcagcagcagatgctgggcgatcagttctcacagctggccagcaacgatggctacatgcagcagattcgccagcaggcgctgtcgcagttaatcgatcaggcgctgcttgatagctacatcaaagatctccacctcagcatcagcgacgatcaggtgaagcaggctatcttcaatcagcaggcttttcagaccaacggtaaattcgacaatgccaaatatctgagtctgatcagcaatatgggcttcagcgccgaccagtatgccgaagcgctgcgtaagcagctctctaatcaacagctgatcaatgccgtggctaacaccgacttcacgctgaaaggcgaagccagcaaactggtggacctagtttcacagcagcgtgagattcgtcaggcgacgctggacgtcaatgcactggcggcgaagcaggccgttactgacgacgaaatcagtcagtattatcagcagcataaaaccagctttatggcaccagagcagttccgtgtcagctaccttctgatggatgcggccagcatgcagcaggatgccagcgaggccgacattcaggcctggtacgaccagcataaagcggactattcgcagccacagcgtacgcgctacagcgtcattcagaccaaaactgaagccgatgccaatgcggtcctggcgcagctgaaagcgggtgccagcttcgctgacgtggcaaaagccaaatccattgacccgatctctgcgcgtaagggcggcgatatgggctggctggaaccctctacgacgccggatgagctgaaaaatgccggtctgactgagaaaggccagatgtcaggcgtcatcaaatcttcagtgggcttcctggtggttcgtcttgacgatattcagccagagcaggttaaaccactggatgaagtgcgcagcgccattgcagcgaaagtgaagcaggagaagggcgttgatgccttctacaaagtgcaacagaaagtcagcgaagcggcaagcaatgacaatgagtcactggcgggtgcagagcaggcttctggtctgaaagcgaaagagactggctggttcagtcaggatacgctgccagatgagcttaactttgatgcggtgaagcaggcgatctttaatggcggtctggtcgggcaaaatggcgcgccgggcaacaactccgatatcatcactgtcgatggcgaccgtgcctttgtgctgcgtatcagtgagcataaaccggaagcggtaaaaccgcttgagcaggttaaggcgcagatcactgacacgcttaagcatgataaagcgacgcagcaggcaaaagctcaggccgataagctgctggccgatctcaaagctggtaagcaggatgcgctgactgcagcgggtctgacgctgagcgccagcaagaccgttgatcgcaatgcgcaggatccggtggcacagactgcctttaacctgcctcagcctgcggaaaataaaccttcctggggtgtcagcgaagatatgcagggcaatgtggtactggtggcggttgataaagttaaaaccggcagcatgccgcaggcgcagattgacgaaatggtcaaaggcgtcacgcagaataatgcgcagctggcgtttgaagcgttactgcaaaacctgcgtaaagaggccaaaattaagtacggcgctgccgcacaaatgcagtaagcctcgcagaaactgcgcaacgactgtaacaatcaaaggccgcattcgcggccttttccatttctgaaatcccgcttttgagccttgcgtgcagtagtgccactctgtcgctgctgtttacacacaaggagaaacacagcatggctaaacctaaactcgttgccctctatctttcactcgcgctgggcggcgcactctgccacagcagcgtctctgcggcacctgaaacctgtcagcgcagccgtcacgcagaactcacaccctgcatcgaagccggaagccgccgcgcagccacagcaggatcaggtcagcattaatgaagcaacagccgaacagctctctgccgttatgaatggggtggggctgaaaaaggcgcaggcaattgtgagctatcgcgaacagtacggaccgtttagcgcaattcagcaactcagtgaagtaccgggtatcggcaatgcgttgatagagcgaaatgcggcccggctgaaattgtgaagcagtacacatctgtgatgcttaacccacgatagacaggcgactctgctaaagtgaacaggtccaaccagttaattcacagcagcaggagagcatgaccatgcagaccaccataaaagtgcgcggctatcatctggatgtctatcagcacgtcaataatgcgcgctatcttgagtttctggaggaggcgcgctgggaatggctggaagaggtggaagcattccactggttgcaggaacagaaactggcttttgtggtggtaaacatcaacatcaactaccgtcgcccggccgtgctgggcgacgtactgactatcgaaagtgagatcacgcagttgaatggcaaaagcggcattattgcgcagcgtgttttgctggcaggccaggagaccgtggtggctgatgccgcactcacttttgtctgtattgatttgcggacccagaaggcggttgcgctggaaggggagttgcgcgagcgactgatgcgtctgatggcatgagccgataaaaaggcggcaacctggattctctgccgccacctcagacactcttagttaagaccgctttttgctttcattgccgccattacgccagcacgatcgttgagataaccctgcaggccattggcccgtaaatgacaggctgcacactcaccgcatccgtcacctttcacgccgttatagcaggtcagcgtctgctcgcgtaccagcgcaagctgctgccagtaatccgccagcgcccaggtttccgctttattgagccacatcagcggcgtctcaaaacgaacatcgcgcgccatgcccagcgacaccgcatggttcagcgctttgacaaactcatcgcggcaatcgggatagccggagaaatcggtctcacagacaccagtgatcaccgcttccgcttcgacctgataagcgtaaaccgaggccagcgtcagaaagagaatattgcgtcccggcacaaacgtactgggtaatccactggcctcgggattataagccggcaccggaatgttatcccgcgtcaggctgctgacggcgagtttcgttcagcatggtgacatccagcactttatgcgcgcgcgcgcccagtttaatcgccaggtcgcgggccacatcgatctcttcccgatggcgttgtccatagtcgaaagtgacgcaatgaacatcatcatattgctctaaggcctgaatcaggcaggtagtggagtcttgtccaccgctgaaaactacaacagcgcgtttcatggcgttttcctgataattaattttgcgcttatggtaatgcctcagtccgccgctgaacagctgcatggcagatcaatgggcggcgggatccatgcgcggctgaaatcgaaccagcccagcgtattcagttcaatcccttcaacgcccggcggcgcgtagatttgatagcgataattgaacagtggcagcaggatgccgcccgtcatcagctgatgataaagctgatgcagcgagcgggcacgggtttcgtcgtcagcaatttgctggatagccagcagttgcgcctgaatctcttcgccctgcagtgtgggccacagcggccgccatagcgggtcagtctgcaaccagctggccagcgtaaagaccggcgcatcaccaatcagtctgtcgcccatcacgatatctgcctcatcaagcgggtcgatgccgtgccagttttttaccggatgaaaaacaaccttcagggtgcagccgtgctgttttaacagtgcaaccagcgcctgtgacatctgatgcagctcaaccggcaactgataatgcagcgtcagggttgccggtaagggaaccctgacagcatcaatcagcggcacactccagccaggtaacaactctttactgggagtgatgagtccctcatccagaggcaaccggctgacaatgccgctttgctggatcagctggaaaagcgtgcacgcctgatcaggggtaaatccggctcgcggccggcagaccagataacagaagccgaggctgatactgctgctgaccggttgcagcgtcctgagctctgtggcatcgcctatcgcaatctgcaccggatgacgacagctgctgccgagagcgggatcaaacagctgaggggtaatccagtactccaccgcctgcagcagaggacgctgcagatgccagcgcgcgtgactttcaatcctgaccagctcggcgctgaagtgcctgagtttccacggcccgctgcccgtgacgggatcgatgggatggggcagcaggcacaacaagtgggcgagccgatggggcagccagaaatcagggcgtcgcagtacgaaacgcaccgcaagcggatggggcgcatccacgctgaccacatcggccagcaacacactgacgcgcgtatcccgcaacagctggcggaattgcgccaccagttgtgcggcctgcagaggctcgtcgttgtgccacatcagctgaggccgtaaccagaataaccagccagatgacgcctcgtcatattgccagtgatgcgccagatcgccgaccggctcatcctgctcaaagcgagtcagaccggaatagatctggcgagccaggtgctgctcggcccgaccggtaatctggcgcggctctgtgctctccatcggacgatagtaggggatgcgcagaaccggcgtatcgtttctgccactgtccgcccattaatggccgcagcatattgatcagcctttccggcggcagatccagcagctgcaaggcctcagcggcgtctccggcgtcgagctgttgttgcagcaactgctgccgtaattgttcaggtgagcgcagaaacactatttgtccctgtttgccacggccaggctcgccgcgccagctgagccagcctgcatgctgccactgtgacagcaacgtgcgcagatgacgctcgctgcagatacagtggcgggccatctccgccacgcaggtttgctgtggggcgccctgactctgctgccacagacgctggaactgattaagacggttaagctggcgcatgttaaacccggaacagttttttaaaagtattcactattagttccgcaattaacaggcaatagtggagttcatctttcagcaggaggtaaatcatggtgcgtttagccgcgttcgatatggatggcacattattgctgccggatcatcagctgggtcagcagacgctggatagcctgcaggcgttgcatctgcgtggcgttaatctggcgctggcgacgggccgccatctgctggagatgcagatcttacgggaaaaaatgacattgcccgcgtggctgattaccggtaatggtacccgtgtacacgacaggcagggcaatctgatctttgcgcgtgatctgccctctgcggtcgccgaagaggtgatccaccgccgctgggatacgcacgccaccctgcatgttttcaacgatcaggggtggtttaccgatcacccacagcctgaactgctggtggcccatcagatcagcggatttggctatcagctgtgcgatcttaaaagattgcccgcgcatcaggtgacaaaaatctgctttatcgatcagcatcagcgcctctgtcagctaaaaacagagctggatgccgcactgggcgagcaggctaacatctgcttctctgctgtggattgtctggaggtgttacccgccagctgcaataaaggcagcgcgctggcactgttatgtgaccatctgtcgctgaccatggcggagtgtatggcgtttggtgatgcgatgaacgatcgcgagatgctggcgcaggccggacagggttttatcatgggcaatgcgatggcgcagctgaaagccgcgctaccgcatctgccggtattagggcattgcgagacacaggcggtgtctcactatttaaatcactggctggcaacacccgacctcgcgtattcccccgaatgctgaggattgccgtgaaccggacaggatgtccggttttttattccagctcgcgctgccatggcgtgatatcgccaatatgttttgccacccactcaggctgatagtagctatcgggataacgtttcgccgctgtcgcacagcagtgtcaccagcgctccctgctgattcgctgcccgtaggcgttttgccacctgcatcatgccccagaaattggtgccggtagaggcgccaggcttgcgtcccagaatcttttccagtttcagcatggcggccagcgttgcaccatccggcactttgatcatttcgtcgatcacgtcaggcataaacgacggctccactcgcggacggccaattccttcgatcatgctgccgcgcgcgctggtcagggtagcatcacgctgctgccagtaatcaaaaaacaccgaatgctgcggatcaaccaccagcagtttggtttccagtccctgataacggatatagcggcccagcgtggctgaggtgccgccggtgcccgcactcatgattatcgtatggggaatcggataaggttcatgctccatctgacggaaaatgctctctgcaatattgttattgccgcgccagtcggtggcacgttcagcataggtaaactgatccataaaatggccattgagctcccgtgccagccgttcagattcagcatagagctggcagggatcttcaacaaaatggcactgtccgccataaaaggtgatctgctcaattttacgcttcgctgtgctcgccggcatcaccgcaataaagggcagacccagcagccttgcgaagtacgcctcagaaacggcagtgctgcctgacgaggcttcgataatcggcgtatcctgtttaatccagccgttggagaggccgtagaggaacagggatcgtgccagccggtgtttaagactgccactgggatgggtactttcatctttcagatagaaccagataccgggaaagtccgccagatcgaaacggatcaaatgggtctcagccgatcgttgaaaatcagcgttaatttcgttgatagcgtggcgaatccagcaggtgtgcatctcaggtgtccggtaaaaaagtgatgcggctattttatggcacgtgcaggaaaaagagattgcacaattaccgctaaaatggcggtaatggagaaaatgattctcccggagccgcgaatgttagataaaactgaccttaaattgctctcactgctgcagcatgactgcacgctgtcgctgcaggcgctggcggatgccgtcaacctcaccaccacaccctgctggaagcgcctgaaaaagcttgaagatgatggcattattcgcgcacgggtggcgttgctggatggagataaaatcggactgtcactgacggcgtttatgtttgttaaaacgcagcagcacagtcgcgactggtatcaggcatttgtctcggtggtgagcagcatgccggaggtaatggccttttaccgtatggcaggcgagtatgattacctgctgcgcattcaggtggccgacatgaaaagctatgatgctttctacaagcgagtagtgaatggggtgcccggcctgattgatgtgacatccagcttcgccatggaagagattaaatacaccacggctttacctgtcgccccctgagggcctgagattgagagcagcgttgtgcgattattcagtcaattaagttggtattttctgcgggagtggcggcgctatctgggcgcggtcctcctgctgattgttattgctattctgcagctgctgccaccgcatgtggtcggggtgattgtcgatggcgtgacgcgtgacaacatgagcaccagccgcatcatgatgtggattgggatcatgctggcaacggcggtggtggtctatctgctgcgctatgtctggcgcgtgctgctgtttggtgcctcctaccagctggcggttgagctgcgcgaagatttctatcgccagctgagtcgtcagcaaccggcattttatctgcgtcaccgcaccggcgacctgattgcgcgcgccaccaacgacgtggatcgggtggtgtttgcggccggagaaggggttctgacgctggtcgactcgctggtcatgggctgcgtggtgctgctggtaatgagcacgcagatcagctggcagctgacgctgcttgcgctggtgccgatgcccattatggccatcgtgatccatcgctacggtaatcaactgcaccatcgctttaagctggcacaggccgccttctccagtctcaacgatcagacgcaggagagcctgaccagcatccggatgattaaatcctttggccttgaacagcatcagtcgcagcaattttccgatatcgcccgcgataccggtgaaaaaaacctgcgcgtggcgcgggtcgatgcccgtttcgatcccactatctatatcgctatcggcttctcaaacctgctggcgattggtggcggcagctggctggtctggcatggagagatgacgctggggcagctcaccagctttgtgatgtatctcggcctgatgatctggccgatgctggcgctggcgtggatgtttaatattgttgaacgcggcagcgccgcctggagccgcatcggcgcgctgctggcggaagcgccagcggtggaagatggcgataagtcactgccatctgaaccaggcacgctgcaggtcgcgattcgtgcctttaactatccggccagcgtgggtccggtcttaagcgatgtcagcttccagctgaaacccggcgagatgctggggctgtgcgggccaaccggcagtggcaaaagtacgctgcttagcctgattcagcgccactttgatattcagcagggcgacatccgttatcaccagatcccgctgccgcagttgcggctggacagctggcgcagccgtctggccgtggtcagccagacaccgtttcctgttctcagacagcgtggcgaacaatattgcgctgggaaaaccgggcgcaacccagcaggagattgagcatgccgccacgctggcctgcgttcatgacgatatcctgcgtttgccgcagggctatgaaacggaagtcggggagcgcggtgtgatgctgtcgggtggacagaagcagcgtctttcgattgcccgggcgctgctgctgaatgcggaaatcctgattctggacgacgcgctttctgcggtggatggccgtaccgaacacgaaatcctgcataacctgcgcatctgggggcagggacgcacgctgattatcagcgcgcaccgcttatcggcactgacggaagccagtgaaatcctggtcctgcagcagggcagggtggtgcagcggggcgaccacgacgcgctgaccggcagggctggctggtatcgggacatgtaccgttaccagcaactggaagcggcgctggatgatgatgaaaatgagaaaggagtgccgcatggctaagtctgcacgcttgtggcctaccctgaagcgtctgctgagctacggtaagccgtggcgcaaatccctgtcgctggcggtagggatgctgtggatcgctgccgcggcggaagtgaccggaccggtgctggtcagctattttatcgacaacctggtggcgaaacatcagatgccctggggagtggtcgccggactggtggtcagttttatcctgcttcagctgctggccgccgggctgcactactggcaggcgctgttgtttaaccgagccgctatcggcgtggtacagcggttacgcagtgacgtgatgaatgccgcactctgtcagccgctgagtgcctttgatacccagccggtcgggcagattatttcacgcgtgactaacgacaccgaagtcatccgcgatctctacgtcacggtggtttcaaccgtgctgcgcagtgccgcactggtcggcgccatgatggtggcgatgttcagccttgactggcgtatggcgctggtggcgatgatgatcttcccgctggtactggtggtgatgttcatctatcagcgttacagcacgcccattgcccgtcgggttcgcagctatctggcagacatcaataatggctttaacgaagtgatcagcggtatgagcgtgatccagcagtttcgtcagcaggcgcgatttggtgagcgaatgggcgaagcgagccgtttctcactatctggcgcgaatggaaacgctgcgtctggatggttttctgctgcgtccgctgttgagcctgttttcagcgatggtgttgtgtgggctgctgatcctgtttagtttctcgatgcctggcgtgtttgaagtgggggtactctatgcctttattacctatctggggcgtctgaatgagccgctgattgagctgaccactcagcaatcgatgctgcagcaggcggtagtttcaggtgagcgtattttcgaactgatggatgctgcacagcagcagtatggtgccgatcaacaaccgctggcttcaggtcgtatcaccctgaacaatctgagctttgcctaccgtgaaaaccgcgatgtgctcagtgatatcaatcttgaggttgccccacgcgagtttgtggcgctggtgggacataccggcagcggtaaaagcacgctggcgaacctgttaatgggttactacccggtgacgcgcggcgagatccgcattgatgatcgacccattagcgacctgagccatgccgtgctgcggcgcggtatcgcgatggtgcagcaggatccggtggtgctggccgatacgctgctggcgaatgtgcggctgggacgcgacatcagcgaagaggccgtctggacggtgctggaacaggtgcagctggctccgctggcgcatgcgttgccggagggaattcatacccggctgggtgagcagggcaataatctgtcggtcgggcagaagcagctgctggcactggcccgggtgctggttgatctgccgcagatactgatcctcgacgaagcgacggccaatattgattccggcaccgagcaggctattcagcagacgcttgagacgctgcgccagcacagcacgctggtggtgattgctcaccgcctctcaacgattattgaagcagacaagattcttgtgctgcatcgtggtcgtgtggttgagcagggtacgcatcagcaactgctggcgatgcagggacgttactggcagatgtatcagctgcagcaggcaggtgaagatctggtatcgggcgtcgctgtaacaactgaaggctgagttgcaccttttttgcgcacctttatcagattaatctgtataaatgcactcctttgacgcctgaagcaccaaaggagtgcagccctccgctgcaattacccctgtacggcctctctgtttcccatcctctttaaagcatcccttgtcgcgtctcgcctgaacaacgtattaccgtcattttcacactctggcacaggctttgcttatatccctgcgtgtccgtaaacgttacctatttactcgctggaggggatccaatgaagctggttaccgtcgtaattaagccattcaagctggaggatgtacgtgaagctttatcctctatcggcattcagggactgaccgtctccgaagtgaaaggttttggccgtcagaagggccatgcagagctttatcgtggcgcagagtacagcgtgaacttcctgcctaaggtcaaaattgatatcgctattgccgacgatcagttagacgaagtggtggatgtcatcagtaaagcggcttacaccggcaaaattggcgacggtaaaattttcgtggctgaaactgcagcgcgtcatccgtattcgtaccggcgagaccgacgaagccgctctgtaataaagactcagtactgtgatgggatggaataaaaatgaataaaattttcgctaagttgggcctcaccagcctggcactgttaccctcactcgcgatggctgcgcctgccgttgcggacaaggctgataacgcatttatgatgatttgcaccgcgctggtgctgtttatgtcaattccaggtatcgcgctgttttacggtggtttgattcgcggtaaaaacgtgctgtcgatgctgacccaggttgcggtcaccttctcactggtctgcgtattgtggatggtttacggctattcactggcgttcagtgaaggcaacgcattctttggcagctttaactgggtgatgctgaaaaacattcagctgaccgccgtcatgggaagcttctatcaatatattcacgtcgcgttccaggcctcgtttgcctgtatcacggtgggcctgattgtcggtgctatcgcagaacgcatccgtttctctgccgtactgatttttgtcggcgtctggctgaccctggcttacctgcctatcgcgcacatggtgtgggctggcggtttcctggcacaggatggcgcgctggactttgctggcggcaccgtggtgcatattaacgccgctgtcgccggtctggtgggcgcttatctggtgggcaaacgtgccggctttggtaaagaggccttcaaaccacacaacctgccaatggtattcaccggcaccgccattctgtatgtcggctggttcggtttcaacgccggttctgcttctgcagcaaacgaaatcgcggcgctggccttcctgaacaccgttgtcgcaacagcgggcgccgtgttgtcatggacctttggcgagtgggcggtacgtggtaagccttcgctgctgggtgcctgttcaggctttattgccggattagtagcgattacgcctgcctgtggttacgtcggcgtcggcggtgcattaattatcggcctggtaggcggactggcgggactgtggggcgtgaccaccctgaaaaaatggctgcgcgtggatgatccctgcgatgtgttcggcgtgcatggcgtgtgcggcattgtcggctgtatcctgactggcgtgtttgcctcctcttcactgggcggcgtaggctacgcagagggtgtcactatgggccatcaggtctgggtacagctctttagcgtgggcctgactatcgtctggtcgggcgttgtcgccttcatcggcttcaagctggctgatttgattgtcggtctgcgcgtttccggaagagcatgagcgtgaaggtctggatgtaaacagccacggcgagaatgcttacaaccagtaatggatgggcagtgaaaagatcaaccgggggcgagtaatcgccccctttttttattcgctgcgctgacgcatcactccttcctgaaccgttgaggccaccagcacaccctgctgattgtagaactcgccccggacaaaaccccgtgcgcctgacgccgaagtactgaccacgctatagagcagccattcactgaagtcgaacgggcggtggaaccacattgagtggtcgatagtggcgacctgcatgtccggctctaaaaagcctttgccgtgcggctggagcgcgaccggcaggaaattgagatcggaagcatagccgagcagatactgatggatacgcaaatcgtcgggcagtgggccggtggcacggatccagacctggcgttcaggcttatccacatggccccgaagaggattgtgaatctgtaccgggcggatctccagcggacgctcagcaatgaatttttcacgtagcttttctggcagcagatgcgccattttctgcgccatcgcctgttcagttaacagattctctggccccgccacctgtggcatcggattctgatgttcaaagccgctttccggtgactggaacgaggcggtcatataaaaaatcggctgcccattctgaatggcactgaccctacgtgcgctgaaacttttgccatcacgcagcgtttcaacatcgtaaataatcgctttctgactatcgccgggccgcaaaaaatagctgtgaaaagagtgaataatgcgatcttccgccacagtttgctttgcggcatacagcgcctgacccaccacctgaccgccaaacacctgacgaaggccaatatcttcgctctggccgcgatataaaccctcttccagtttttccagatttaataaattcagcagattttgcagtgcctgactcatggcgcgttcctcaatatagtgacctgctcagtttgaaagatcggaccagttgacgtcaatcagactttctacattgtcggtgccaggcaaaatttcatttttgtgccaacattaaggacatacggcgagtgaagcgctgtaagcaggattcgctgccgacaatcattttgatcaaatggagacgacatcaatgaaactcaggcatgtgttcagtggagtagttatggcggttgctgttgtaggatgcgccgacaagagtaaacccgtgccaacgccaactctgggttctgcggttgcaggacagacggcggcgattgcgcagcccaacgtaagtggttcagtctttatccgccagcgcattgcgctgccgccggatgcggtattaaccgtgacgctctctgatgcgtccgtcgccgatgcaccctcaaaagtgctgtcgcagcgcgtggtgcgtaccgaaggcaaacaggcaccgttccagttcgtgctgccgtttaacccagccgacatcaagcctgatgcacgcattctgttaagcgcagccatctcaatcgacggtaagctggcctttatcactgaaggcgtgaagccagtgattaaccagggtggcaccaaagcagagctgctgctggtaccggtaccgtctatggcgatgccaacccagccgggcgcagcgaccaccgttccttcgacctcaccgactcaggtgacgccgtctgctgcggtttcctgctccaactcgtctgtaaactcatttcggggcgacattgtcgccctttttaccctgtctaaactcgccagcgataagtttcgagatcgagctgtccatcatcactcacctctatgccttccgcctccagtgcatcccgctgccgcaacagacggtcaccctgaagagaaattgtgccgtgtcggtttacgacgcgatgccagggaagggtagtgccctcgggtaagcgactcagcacgccaccaacctgacgcgccgcgcgcggagaaccggccagtagcgccacatcgccataggtggtgacgcggccagccggaatagcggcaacaatttgccagatgcgttgctggaaagtgtctggctgattcatgtacttatttcatcaggaaaaagggttttaactttagcacggggaaaaggcggagaaagcgtaaaagcggtggttgttcaagaaaacaacggttgtcccgactacgcttgcaattgccacctccttcccagataatgcccccgctctcgtaaagagggcttgtcaatgggggccctgttggttctcccgcaatgctagcttgtgaactcggtcagatccggaaggaagcagccgtagcaggtgacgcgtgtgccgggatgtagctggcagggcccccaccactttctcccttcgatattctccccctaagctgcagacaggcaaaacccgcctgggccgatcctttgccggcaggcaggattatccggtactttattggggtaaaactgagctgtaagcgatcagattaacggacaaatttccatactgaacccgggactttatcgtagagcttgttcatcgtcagtttccgccaggcgatggtcagctgctgagtaaaataccgctaattcatcttccggtaattcatacttatttttttcaatcaccctttccagggtatcaagagagcggcagcgccgcagtcgcatcaaataatcggttttagtcagggttttgttcataaataaaccgttctcatgtctttactataatgaatggctcggttgctggagaaaagcgcactcttcagtgaacagattaaataagcgttttgctgaacgttgccaccgctgaagatccggactattgacaccataattgctgaatagcataaaagtatcatcaagatattcatcgatttgcgaaatcagcgcttcatcttcaacgtgcttaattttgtaattcatggtgaaagaggcgatatgctcaatcaaatcgttaagctgtagattgctttcagaagtgggatcattaacccagccatgatgactgtcggttaatgttgccatgctgtcgtcaaacagactctcacaaaggtatttaagctgggcaatatcatgccgtttcggtgagtattcgtccatctttttcccctccatagctagcacagttgccgcagggcggcgagagaagatcacgcggccaggaagcgattattcgggcagttattaaacgggataccttaaagatagtgtaaaaccattagttctgctcacctccattactaaatattacaattcatcgccaggggagggttgctcattgtcgatcacatcaaactcaagtgcaccgggcttaatgtgaaagtttacctgttctgactgcgtcacggtttcatttagatccaggcagggactaaataaattccagtcaaaatcgtaaagtaatttaaaactattcagatcctggtattcgaccgaaatgatttttaaactgcctggaactaaccgggcattttgtgagtaccagcgtaaatcccctaccagcaaatcggttattttgagaatattccgctgaacaatctctgctatttttgcgcagtccgattcacccgcggcaatatcacattcaatgcgtgacagcatatctgttccacttataaccgttaataaacctatcattggttttctgcaacgggtttgcaagtcagttgagcacaaaactctcagtttctgagatttgccagacgccgccgcaggccttatcgccagcgcgggtctgccagtgcgtgcagctgatatttatcttttgatacacaatcccacattcaacagagagcaacatcaggtatctttactgttatgttataacatcatggtgaggtaatgcgtcagagtggactacttatgtcactgggcgggcggctgggagtagcactgctatttatcacgctgcttgctgtggcaataaaatgggggatcagcacatgatcctgtttaacgcacttcgcgcgggctaccagggacaggttgtgaccccggctattaccggccagctcgcagccggctcgatgaccgcgctggtcggcgcgaaacggtagcggcaaatcaaccctgttaaaaaccattgctggcttactgccaccgatagccgggcgctgcgagctgcaggttgcacgccgggatatcggctggttgccgcagcgcaccgaacttgagacccgctttcccctgacggtatttgaactggtctctattggctgctggccacgctgcggctggttcggcggcattaaccggatactgcgtcgggagatctggcaggcgctggaagcggttcagatgagtgattatgcggatgcgcagcccgcgacgttatccggcggacaactgcagcgggtattgtttgcgcggctgatgctgcagcgcagccagctctggcttctggatgagccttttaacggcattgacagccagacggtgacgctactgatgtcgatccttgagcagcaacagcaggccggaacaaccctgctggtggtgctgcacgatcgtccgctggtggcgcgctacttcagtaacgtgatgtcgatggatgaacgtgaggttaactgcacctgcctgcctgcttcctctctgcggagtcgtgcgccgtgaccctgattcaaccctttattgagtttggttttatgcgacgcgcgctggtggcctgtctggcgctggccgtcagcgccacgccgctcggggtattcctctccctgcgacgtatgagcctgattggcgatgccttatcacacgcggtactgcctggtgccgccattggctatctgatctccggattgtcactggtcgcgatgggtgttggcggcctgatcgctggtttagccgtggcgctgctctctggcgcggtcagtcgctacacgccgctgaaagaggatgccagttttgccggcttctatctgggttcactggcgctgggcgtcacgctggtttcattacgcggctcaagcgtggatctgctgcacgttctgtttggctcgctgctggcggtagacaacgcagcgctgttgctggtgggcggcatcgctgcctttacgctgattctgctggcggtgatctatcgtccgctggtcatcgatgcgtttgacggcgacttcctgcgtgcgcagggaaaatggagcgcgccgctggtgcatggtctgtttttaatgctggtggtgctgaatctggtggcgggttttcaggtgctgggcaccctgatgtcggtgggtttaatgatgttgcccgccgccagcgcccgcttctggagtcgccatctcgccgcaatgctggttatcgccattttcatggcaatgatttcggcgctggccggtctgatgctctcctggcacttctcattgccggcgggtcccgctgtagtgctgagcgccgccatgctgttttttttctccattcttacagggccgtgcggcggaattttacgccgccattaatcttaaggggtatctatgaaaaaattaccggttagcgtggcactcgctgcgctgtttgccacgcctctggcgatggccaaaacggtggatgtcgtggccagctttaccgtgctggctgacatcgttaaacaggtcggcggcgatcatgtaaaggttaaaagcctggtagggccgaatggcgatcctcatacttttgaaccgacaccgcaggacagtcaggcgctggcgaaggccgatgtggtgtttgtcagcggactgggactggaagggtggatggatcggctggtcagcgcctcagggtatcgcggtcaacccgttgtcgcctcaaccggtgtcaccactcgcagcatggaggaggagggtaaaaccgttaccgatcctcacgcctggaacagcatgcagaacggcgttatctacgcgaccaacgtgatgaatgcgctggtcaaagccgaccctgaagatgctccggccattcgtcagcgtggacagaattacattcagcaactgcaggcgctggatcgctgggcaaaaaccgcctttgacgctgtgccagccgataagcgtaaagtgctgaccagtcatgatgcgtttggttactttggacagcgatatggcgtgactttcctggcgccggtagggtttctctactgaggcggaagcgagtgccagcaacgtgggtaatttaatcacccagctgaagcagcagcacatcaaccgctatttcattgagaaccagaccgacccgcgtctggtaaaacagattgccagcgccaccagggcagagccgggtggtgagctctatccggaagcgttatccacggcctctggcccggcagccacttatcaggcggcttttaaacacaacgtgaatgcgatgctgaagagcatgcactaagcataaaaaaggccgggcaagcccggccagtcatcacgacacaaactagcgttttttctttcttccctgtactgctttaaaccgcgggttcgatttacagatcacgtaaatacggcctttgcggcggaccactttacaatcccgatggcgattttttgctgaacgcagcgagcttaatacctgcatgatcctctcctctatttctttccaagaaagcgcccgaaacgctggttaaagcgcgcggtgctgccctctttggcaaaatctttctgtttgccggtgtagaacacatgtgaggcagatgacacatccagggtgacgtagggcagcgtttcgccttcgaactccacagtgcgatcggttttgatggttgatccgattttgaaccagacatcagccgatgtgtcatggaagaccacgtgacgatagtgaggatgaatattcgctttcataatgcacacctatgtaatgttataatataacagtattatgcgatgcacaggccaggattgcaactgtccgtgagacaggaaaagcaaggggacaggaaaggagaagggcataatcgcaggcataaaaaaaggccgcttgcgcggcctcagatgatttacagcttagtgagtctggttatgctcaaccggatgactgttcgctgattcttcttttttcttgccaaagcggcggcgtaccaccacaaagaacacaggaacgaagaagatcgccagtatggtcgcggtgaccataccaccgataacaccggtacctacggcgttttgcgaaccggaaccggccccggtactgatcgccagcggcagtaccccgagaataaacgccagtgacgtcatcaggataggacgcagacgcatacggcacgcttccagcgcagcttcaatcagccctttaccctctttatccatcaaatctttagcaaattcgacgataaggatggcgtttcttggtggagaggccgatggttgtcagtaaccccactacgaagtagacgtcattactcaggccacgcagggtggtaaagatcagtgcaccaatgaccccgagcgggacaaccagcataaccgagaatggaatcgaccagctctcatacagtgcggcgagacacaggaagaccacaatcagcgagatggcatagagcgcaggggcctggttgcctgacaagcgttcctgataggacataccggtccagtcatagccgataccggcaggcagtttcgccgccagctcttccatcaggtccattgccgcacccgaacttttgcctggcgcagcctgtcccaggatttccatcgcaggcagaccgttgtaacgctcaaggcgtggtgaaccatattgccatttcgctgacgagaaggcagagaagggcaccatggttccgctgctgttgcgcacgtaccatttaccaatgtcgtccggcagcatgcgggcgtccgctttacccatgacgtaaactttcttcacgcgaccgcggtcaatgaagtcattgacgtaagagccgccccaggaagccgccagcgtggtgttgatatcactcagtgatacgcccagcgcctgtgctttctcctgatcgatcgtgagcttgtactgcggcgtatcttccatcccgttgggacggacgccaaccagcgtatcaggatgttgcgcaatcatgccgaacagctgattacgcgcttccgtcagcttatcgtggccaaggttattctgatcgatcagctcaaagtcgaagccggtcgcgttacccagttcaataatggctggcaggttgaaaggaatgaccattgcatctttgatcgcgcccagcgcctgcatggcacggccagcaatcgccggtactttcatgtcgctgccggtacgctcatcccacggcttgagactgacgaaggcgataccggtgttctgtccacgaccggcaaagccgaagccgttaacggtaaacaccgatttaaccgtgtctttctcctgggtcaggaagtaatccgtcacctgatccagcactttctgcgtacgctcctgggttgcaccagcaggcagctgcgcctgagccagcagcagaccctgatcctcttccggtaagaatgaagagggcagtcgcacaaacagaaacgccataccgaccacgatcaccagatagatcaccatatagcgacccgtactgcgaaccatgtgacccacaccatccacatagtggttggtgcttttgtcgaacatgcggttgaaccagccgaagaaaccggtggttttaccgtgctcgccttttttaatcggtttcagcatggtggcacagagtgccggcgtcagaataaaggcgaccagcaccgacagggccattgccgaaacgatagtgatggagaaactgacggtagataacaccggtcgaaccaccaaagaacgccatcggaataaatacggcagccagcaccagcgcgataccgaccagtgcgccctggatctgctccatagaacgcttagtcgcttcttttggcggtaatccctcttccgccattacgcgctcaacgttctcgaccaccacgatggcgtcatccaccagcaagccgatggccagcaccatcccgaacatcgtcagggtgtttatcgaatagccaaaagcgctgataacggcaaaggtacccagcaataccacggggaccgcaatggtaggaatgagtgtggcgcggaagttctgcagaaacagatacatgaccaggaacaccagcacgatcgcttcgatcagcgttttcaccacttcgaaaatcgagatcttaacgaaaggcgtggtgtcatacggatagaccactttcaaaccggccgggaacgtcggctgcaatttggccagttcttctttcaccgcattggcggtatccagcgcattcgcaccggtggccagcttgataccgataccggacgcaggcttgccgttataacgggcaacgatttcgtagttttccgcgccaagttcaatccttgccacatcacgcagacgaacctgagaaccatcttcattcactttcagcaggattttgccgaattcatcggtagaggtgagacgggtttgcgcaatgatcgaggcgttaagctgctgtcccggaaccggaggcgtaccgcccaactgaccggcagcgacctgggtgttctgcgtattcagggcgctgataacatcaaccggcgtcaggttgtagttgttcagcttgtgcggatccatccagatacgcatcgcgtactgcgcaccaaatacctgggtatcacccacgcctttggtacggctgatcgggtctttgatggacgatgaaataaagtcagaaatatcattctgcgtcatattgtcatcgtcgctgatgaagcccgctaccatcaggaagctactggaagatttcttaacctgaatcccctgttgctgtacttcctgcggtaacagcggcgtcgccagctgcagtttgttctgcacctgaacctgcgcgatatcggcatctgttcctgactcaaaggagatcgtcagggtcagcgtaccggatgagtcgctgcttgaggacatatacatcagtccatcaatgccgttcatattttgttcgataacctgggtcaccgagtcctgcagcgttttagcatctgcaccagggtaggtggcctgaatctcaatcgccggcggtgcaacattgggatattgctcaatcggaagtttgagaatcgatagcgcaccgaccagcataatgatgatggcgagcacccatgcaaagatgggccgatcgataaagaacttagccatgaatcaacggctcctgttatgacgatgacttgtcagactgcggctttgaatcgggtgccgctttcgcatcgtctgagacttcttgtggggtaacctgtgcgcccggcttggctcgctgcagacccgtgctgatcacacgttcacccgctttaacaccgtcggtgactaaccacttgtcgccaatcgcctgagaggtggtgacctgacgagcttccactttgttatctgcacctaccaccatgaccgttgcctgacccgttggggtacgggctaccgcctgttgcggaaccagcaacgcattaggattggtaccttcatccagacgagcgcgaacaaacatacccggtaacagcgcatggttcgggttcgggacaatggcgcgcagggtgatagaacccgtggtttcatcaacggtaacgtcagagaaactccagcgtacctgtctgtggatagctgttgccgttctgcatcagcagggtcacgttggctttgccatcgttctgcttcagctgacccgactccagttctgaacgtaagcgcatgaaatcttcgctcgactgggtaacgtcgacatacatcgggtcaagttgctgcacagtggccagggcggtggtttgtgcgttttgtaccagcgcaccttccgttactgacgatttgccgatgcggccactgataggcgaggtgactttggtataagccaggttaatgcgggccgtttctacattggcttttgctacctgaaccgcagcatcgttttgcgcggccgtggcaacggcggtgtcgtaatcctgctgactgatatatttggtgccgagtaaaggcttataacgtttgacggtcagctgagcgatgcgagcattggcctgcgcctgagttaagtcacctttggcgctgtcataggcggcctgataggtagcaggatcgatctgataaagagactgacccgctttgacatcgctgccttcaacaaagttacgcttcagaatgataccggaaacctgcggacggacttcggcgacacgatatgccgaggtgcggccaggtaattcagtcgagattttcaggggttcagttttcagtgttacaacccccactgctggcggttgctgggcggcttgttcggatttattgttgtcacatcctgttaacaaaaagctgcctgatagcatcaggacggccgccagaggcgataatcctctgattttattcataaataaacctctagtgtccgatatcaattggtcaatggatcacaaactgaaaaacccattgctgtgtcaagtcgcaggtcatgctatggtacatacattcgcaaatgtatgtaaacttacctgtttgtaaaaaaagccccttatggcacgaaaaaccaaagcgcaagcacttgaaacgcgacatcaaattcttgatgccgccattgttctgttttcgcagcagggcgtttcagccacttctctggcggatattgcaaccgctgccagcgtcacgcgaggggccatctactggcacttcaaaaataaagccgatgtattacatgaaatatggcttcgttgtgatgctggtctggacgatgtggaacttgagtatcagacaaaataccctggcgatccactctctgtgttgcgagcgatgctggtctatatctttgacgcgacagcaaaggatccgcagcgccgcgccttgatggagatcattttccacaaatgtgaatttgtgggcgaaatgtcggcgctgaagaatatgcagcagagcttactgctggagtgctacgacaaaattgaagaagtcctgcgccagtgtatcgaagccggacaacttcctggcagtctcagcacgcgtcaggccgctcttatcctgcgcggttacgtcaacggtatgatggaaagctggctgtttgcgccggacagttttgatttagccggagacgcgccgacgctggtcaatgcctttatcgatatgctgcgcctcagtccgacgctgactgcccaccactaagccgatgggcgatcacgcttgttttcgaaatcgcgctgcaccatggccagcgctgagagcacggtttctatcggcagttgatgctcttccagtagctgaatcagatcaactgccagtttgacgtcgtcaggggcattttccagtgacatctcttctcctaaatacgtagtcgggccgcgaccagcagcatcactaatgcaccgagaatcgccatgcccagtgcgccaatatgcagcgttgccagggtacccaggtcaaaataggtggcgatatagccgccaatcagagccccgatcatcgacagcgtcagggtagcaaccaggccgcccggtggtcccggcatcagcaggcgcttcagcaaccccagcagtaaaccgcttaacagccacacaagtaaagccatggttcttctccgcgccgaatcacacccagtataggagcgcttttgtcacgctgcgctttattcgctgccgcgcaacgaagaggcccattcgacagagcgaatcgcctgccgacagcgtgccagtcgctgctctaacgtttccagatcctgtttcagctgatgctgtaccgccagcgtttcggccagcgccagccgctgctcacgctgatcgatcattgccagcaaacgccgttcaaattcacggtactcctgatattttgcggcgcgtgggtttcctgacgggctgttcgcgtcgggtacgcagctgttgcgtactcgcctcacgttgcagggcggctatctgatcgaccaggcgttcagccagccacgcactgcgggccagatcgtggctgctgtcgcagagccgggcaaaattctgttccacttccagcaggtaatcagccagccgcgtgcctttggtgcgaaacagctgagtatcaaaacgtggcagacggcaaaccccatctgaatggcaggcgagttcctgccgcagggcgataaggagctgttgcaggcgctgttgtatggcgatcgcactcatcgcgtcacgctcaattgtgctaacgtacgctgatgaggaaagagttgggcggcattcatgcaacgcattctgttattaaccctcggctggctggcgattgtgctggggacgctgggcattgtattacctttattacctaccacgccattcatgctgctggcggcctggtgttttgcccgttcatcgccgcgttttcatcactggctgctgtggaaatcgccatttggtcgctatctgcgccactggcagcagcatcgcgcgatgccgccaggggctaaagtacgcgctatctgcctgatagtcgccacctttagtctctcactcttcctggtgcatcagctctgggtacgcatcatgctgctgatcatgctggcggcgctgctgctgtttatgtggcgtattccggtggtggcagaagcagcggacgcaccgccgccgccgcgataaagttgcatttagccggtcatttgcttagatttgggcgtcttcgtgcgtggcttccctttgtgaattgacttccgctgagcctgttatcaggtattagcgcttttgaagctgcgcgaaacagaattttttaccaggcgtatcattatgaccgacactgcgcagcagcttgaattcattaaaaacagcattaaaagcattcccgattatcctaagccaggcatcctgtttccgcgatgtcaccagcctgctggaagatcccaaagcctatgccgcgtcgattgcgctgctggttgagcgttaccgtaataaaggcatcactaaggtggtggggacggaagcgcgcggtttcctgtttggtgcaccggtggcgttaggcctcggcgtcggttttgttccggtgcgtaagcccggcaaactgccccgtgaagtctacagcgaatcctatgagctggagtacggcaccgataagctggaattgcacaaagatgccatccagccaggcgatctggtgctggtggttgacgacctgctggcgaccggcgggacgattgaagcgaccgttaaactgattcgtcgtgcaggcggtgaagttaaagacgcggctttcattattaatctgttcgatctgaccggagaaacgcgtcttaatgccatgggcgttgagagctacagcctggttaaattccccggccactaagccactctttcggccttgccatccggcgaggccgtcacgccttcggcgtcaagataacgagtgccagccaaaagcgtagctgatagactactgcaatcttatacaggggttgcagagcgtctgcgctcatctttccatccaacttcgtcgaactccacatgagctatcaggtacttgcgcgaaaatggcgtccccaggcttttgctgatgttgtcggtcaggaacatgttctgacggcgctggcgaatggattgtctctgggacgcatccatcatgcttatctcttctccggcacccgcggagtagggaaaaccactattgcgcgtctgctggccaaaggccttaactgcgaaaccggtatcactgccaccccctgtggtcagtgtgataactgccgtgaaattgagcagggccgctttgtcgatctgattgagattgacgccgcatcgcgtaccaaagttgaagatacccgcgatctgctcgacaacgtgcagtacgccccggcgcgtggccgcttcaaagtctatctgatcgatgaagtgcatatgctgtcgcgtcacagcttcaatgcgctgttaaagacgctggaagagcccccttcacacgttaaattcctgctggcgaccaccgatccgcagaaactgccggtgaccattctctcgcgctgcctgcagttccacctcaaagcgctggatgtggatcaaatccgtcagcagcttgagcatgttctgaagcaggaacagattgagagtgaaacccgggcgctgcagctgctggcgcgggctgccgatggcagtatgcgtgatgcgctgagccttaccgaccaggccattgccatggggcagggcgcggtgaccagcagtacggtcagcgtcatgctcggcacgctggacgatgaacagccgctggggctgctggaagcgctggtcgacggtgacggtcagcaggtgatgaatctgttgagccaggccgcgtcacggggtgtggaatgggaagcgctgctggtagaaatgctgcgcctgctgcaccagattgcgatggtgcaactgctgccgacctcgcttaatgacgatgatgagagtaacgcccttcgcttgcgtgaactggcgcgggtggtgccgcccgccgatctgcaactctattatcagactctgttgatgggccgcaaggatctgccgattgcgcccgatcgtcgcatgggtgtggagatgacgctgctgcgtgcactggcgtttcatcctaaagctgccgtagctgaacccattgcgcgtcccgcattaactcagcagacggcgcctgtcgcccctgcgcagacatcaccggcagcatccgggccatcgccgttagcacggcaaccggcagcacagccagcctcaccgtcacctgccgctgcgccgccgtcgcacaccgcgtcgcccgtcgcgcagcagactcaacagcagatgccggagcagacgcagcagcaggttgctgctcagccgcagatggccgcgcccgatgctgcaccgcagcattcgccgtcgccagatgtcacacctgacaccgcactctccagttccaccagtcagctcctgcaggcgcgcactcagttgttgcgtcagggagcgaacaagccaaaaaagcgtgagccggcagcgccaggtgcgcggccggccaactccgcgctggagcggctggcctcggtcaccgagcgcagtcagcagcgtatccgcgatcgcgagcctgccgccccggtaaaagaggaagcgtaccgctggaaagcggttaatcagccggtggaagtggcggagccggtggcgacgccaaaggccttgcgttctgcgctggagcatgagaaaacccctgagctggcggcgcgtctggccgaagaagcgcagcagcgcgatccctgggccgcagagattgcgatcctgccgctgccgaaactggtgcagcagctggcgttaaatgcctggaaagagaccaccgaaactggggtctgcctgcatttgcgtagcagccagcgtcaccttaattcaccgtcggcgcagcaggtattaagcgatgcgctgagtcagcatgccgggcagagagttgaactctcggtagttgaagacgataattcatcggtgttgacgccacttgaatggcgtcaggccatttacgaagagaaactggcgcaggcgcgtcagtcgatcacctgtgatacccacattcagacgctgcagcgcttttttgatgccgatctggatgaggagagtatccgacctgtttgaacacgctgctgctatcttaacgatagcgttgtagcctcagctgagagagaaaactatgtttggtggtaaaggcggattgggcaacctgatgaaacaggcccagcagatgcaggacaaaatggccaaggttcaggaagagattgccgcgattgaagtgaccggtgagtctggtgctggcctggtaaaagtcaccattaacggcgcgcacaactgccgtcgcgtggaagtcgatcccagcctgctggaagatgacaaagatatgctggaagatctgattgcagccgcgttcaacgatgcggcacgtcgcattgatgaaacccagaaagagaagatggcttctgtctcttcaggcatgcagctgccaccaggctttaagatgccgtttctgatgcaaaccagtccactgcttgaatctttgatggagtcgctgcgctgtctgcctggcgttgggccgaagtcggcacagcgcatggcgttccagctgctgcagcgcgatcgcagcggtggcatgcggctggcgcaggcgctgacccgggcgatgtcggagatcggacactgcgccgattgccggacattcaccgagcaggaaatttgcaccatctgcgccaatccacggcgtcagcagaatggtcaaatctgcgtggtggaaagcccggcggatattcacgccattgagcaaaccggccagtttggcggtcgctactttgtgctgatgggacatctctcgccgctcgacggcatcggtccggctgatattggcctggaccgtctggagcagcgactggagagtgaaaccctgcaggaagtgatcctcgccaccaacccaacggtggaaggcgaggcgaccgcgaactacatcgcggaactctgtggtcagtatggcgtcgacgccagccgtatcgcgcacggcgtgccggtgggcggtgagctggagatggttgatggcaccacgctgtcccattcactggcgggccgccagaagtttaaattttaatcacttgccggtgttgtgacagacaccggcttgaaaatctccctgtcacccccacatcaacctcaacgtttgttcaacctgttttgttgaggtagcaatgaccatgaaaggacaagagacccgtggctttcagtcggaagtaaaacaacttctgcacctgatgatccattctctctattcaaacaaagaaattttcctgcgtgagctgatctccaacgcctcggatgcggcagacaaactgcgcttccgtgccctgtcagattccagcctgtatgaaggtgatggcgagctgcacgttcgtctctctgttgataaggacaaccgtaccattacgctcagcgacaacggtatcggtatgcgtcgcgatgaggtcattgagaacctcgggactatcgccaagtcaggcaccaaatccttccttgaatcgctgggctccgatcaggcgaaagatagccagctgattggtcagttcggtgtcggtttctattctgcattcatcgtggcggataaagtcacggtgcgtacccgtgccgcgggcgcgtcagccgaagaaggcgtgttctgggaatccgcaggcgagggcgaatataccctggctgaaattgagaaagccgatcgtggtaccgagatcaccctgcatctgcgcgaaggcgaggatgagttcctggatgcatggcgcgtgcgcaacatcatcagcaaatattccgatcacatcgcgctgccggttgagatcgaaagcaaagatgaagaaggcgaagggacacactgggagaagattaacaaagcccaggcgctgtggacccgcaacaaatctgagatcagcgacgaagagtacaacgagttctacaagcatatcgcccacgattacagcgatccggtcgcctggagccacaatcgggtggaaggtaagcaggaatataccagcctgctctacattccggcgcgtgcgccattcgatatgtggaaccgcgatcagaaacatggcctgaaactctatgtgcagcgcgtctttatcatggatgacgctgagcagtttatgccgaactatctgcgctttgtgcgtggcctgattgactcgaacgatctgccgctgaacgtctcccgtgagatcctgcaggatagccgcgtgacccagagcctgcgcgccgcgctgacgaagcgcaccctgcagatgctggaaaaactggcaaaagatgacaacgagaaatatcagaccttctggaatgagtttggtctggtgctgaaagagggcccggcggaagatcacgctaaccaggagacgatcgctaagctgctgcgtttcgccactacccagagcgaaggttcagcacagaccatttcgctggaagattacgtcagccgcatggtggaaggtcaggagaagatttactacatcaccgctgacagctatgccgccgcgaagagcagcccgcatctggaactgttccgcaaaaaaggcattgaggtgctgctgctctccgatcgcatcgacgaatggatgatgagctatctcactgagttcgatggtaaaaccttccagtcagtcagcaaagcggatgaatcgctgagcaagctggcggatgaagagaccgaagagcagaaagaggcggaaaaagcgctggagccttttgttgagcgggtgaaaactctgctgggcgaacgtgtgaaagaggtgcgtctgacgcatcgcctgactgatactccggcgattgtcaccaccgacgccaacgagatgaccacgcagatggcgaagctgtttgccgcggccggacaggaagtgccggaagtgaagtacctgttcgaaatcaacccggatcatccgctggttaaacgtgttgcggatacgcaggatgaagcacgcttcggtgagtggattgagctgctgctggatcaggccttgctggccgagcgcggcacgctggacgatcctaaccagtttatccgccgcatgaaccagttgctgaccgcataatggcaacaggccggtggttttcaccggcctcagacggctgataaagccacagcatcaagccggtgaccctcaccggctttttttatggttttgcggcatcctgcagccagtcgcgaaacaggctgatctccatatcgtgccgacggctctgttttgtcatcatccatgtggcccgctcgacgcgtacaaagccaagcggcgcaagcagcgtgccatcctccagctctttgcgtaccagcaaacgcggtgccatcaggacgccaagaccacttcgtgcggcctgaatccccagtgtcagactctcaaaatgcttaccgccgttaaaacggccgctgaccccagctttgtccgcccactctgaccaggcgtgcagccgggtatccgcatgcagcaggggcatcgcggccagatcctcgccgccccgcagctgcgaggcaaagtgaggtgcgcagagcggcccaatctcatcctcgctgaccagcgtggcgtctatgtcagattcagggggctcgccgtgactgaggatcagtacatccacatgttcgctgcgcagttgcgagatctgcgtcagcggctggaagtgaacctcaatctccggatagcgttgataaaaactggcgatacggggaatcagccattgcgacaaaaaactgggggcgcaggatacccgaatctgctgaagcagcccggtacgaatgctttcgcagctgctgcgcaactcactgaacgcctgctgacagctcagcagcagacgttcaccgtgtgaggtcagtttcacgcggccatggctgcggacaaaaagtggtttgcccatccagctctccagctggcgaatctgatggctgatggcgctgtgcgtaacatgcagatgttcagccgccacgctaaaactgctgtgtaaggctgcctggtgaaaatagtgcagcgctctcagtggcggcagtccgttcatcctcttcccctgtgcaaaaatctaacagggattgtcaatttatatcattttaaagtccagccgcattgacctactctgtagggcaaattctggcgggttgactcagccttatatctgtgatttttcagggtattccgcctcgcttaaccagcgttcacgccgcacactccccgaagcgagacaaccatggcacaccgctctttatcctctgaaacttcagcagaggcgcgccatcggttacgcctggcgctctcacgcttttaccggctcgagcagttcgatctcttcttcgcgccctcgctgcatgtggcgcaggtccttctttctcagctctttctgcggcaggagcaggcgcgcaatcagcatcgttacgcctcgcactttccggtaaccgaactcaacatcctgccagcagttccgctgatcgctggcagcatcatgctggtaccgcatgtcgaattgcccaatggccgcgtgcgtccgctgcgggattgccagaaccagggcgtgacggaggcgagcgagagttttgccagcgtgctgcatcagaaactgatcgacgaagcccatctgtttgtcacccgactggatcgccacgccgagatctgcagcgatctggtgctggtggcgttgcggacacatgacttcagtacgctggtgcgcagcgaactgcggcttttcgaacaggggctgaccctgaccgccacgcatgaggcactgcgccgcttcgacgatccgcactggcggccttacaatgccgccaccgtcgatgcgctctccctgtcagacccgctgccgctgaactcctgccatcagcccggtttgccgtttgccagctttaatgtcccggcctccgtgatcacatcgctgtcagatgcggaagatgtggtgaaatggccgcagcaggcgcggctgctgctgaatgctaacgtgcgcggcagcggcaaaaaaagcgtgaatatgacccatcatctgagccgacgactgcaattcctgctcggctcaggcggtaaatctgaaaaagcgtccggcaggccaggcgggtaggggtcagggccaaaaagcgactcaggtcgccctgcgcgatccgcgcccttccttgtgatgagcgggtcataatggtatgttctttcgcttctaagatagatcaatgcgattcgcaaggggatttacgcaatgcgtattattctgctcggagctccgggcgcaggtaaggggactcaggcccaattcatcatggagaagtatggcattccgcaaatctccaccggcgacatgttgcgtgcagcagtaaaagcaggcagcgagctgggcaaccaggcgaaagccatcatggatgctggcaaactggtgaccgatgagctggtgattgcgctggtcaaagagcgtatcacccaggaagactgcaaaaacggtttcctgctggacggtttcccgcgcaccattcctcaggcagatgcaatgaaagaggccgggatcaccgttgatcacgtgctggagtttcgccgtaccggatgaactgatcgttgagcgtatcgtgggccgtcgcgttcacacgccatcaggccgcgtttatcacgtcacttttaatccaccgaaagtggaaggcaaagatgatgtgaccggcgaagagctgaccatgcgtaaagacgatcaggaagagaccgtgcgtaagcgcctggtggaatatcatcagatgaccgcgccgctgattgcttactacagcaaagaagcggaagcgggcaacactgcctatcacaaaatcgacggcacccgtaaggtgaccgaagtcagtgccgagctggctaagatcctgggctaagttcacaggggccggtattactggccccttttgcagtaatcgcttttacctcccactaattccgctacaatttccccgttttcacgcatccccgttgttatcaaggaactcaaatgaggcaagataaggccggcgtgttattggttaatttaggtacgccagacgcgcccaccacacctgcagttaaacgctatctgaaacagtttttaagcgatccgcgcgtggtcgatgcgccgcgctggctctggtggccggttctcaatgccgttattctgccgtttcgctcgccgcgcgtctctaagctctactcatcggtctggatggaaggcggttcaccgctgctggtttacagcatgcgtcagcgcgatgcgctggcggcacgggtcgatatgcccgtcgaggtgggcatgagctacggtaatcccagcctgaaaagcgcggttgataagctaatggcgcagggcgtgacccgcctgattgtgctgccgctctatccgcaattctcctgctccaccgtggcggcagtgtgggatggcctgaccgcggtattcaaagattaccgctcgctgcctgatgtgcagtttatccgcgactacgccgaacatccggcctatatcgccgcgctgaaagcgacggtggagcgatcctttgagcggcacggtcagcccgatctgctggtgttatccttccacggcattccgcaacgttttgctaacgaaggcgatgactacccgcagcgctgtgcggataccacggcggccctggtcaaagcgctgggcctgcgtgacgatcagtatatgatgacctttcagtcgcgttttggtcgtgagccgtggctgatgccctacaccgacaaaaccatggaaagcctgcccgctaaagggatcaaacatgttcaggtgatgagcccgggcttctcgtcagactgcctggagacgctggaagagatcagtggtgaaaactgcgaaatctttatgcatgccgggggtgagaagtttgagtatatccctgcgctgaacgccgatgaggcgcatatcgacatgatggtgcaactggtcgacgcacgccgttaaagcgcaggcggagagtgtgatatcattctccgcctgtttttccagacggcacctcccgatgaaatttcccggcaaacgcaaatccaaacactactttcctgtcagcgcacgcgatcccctgttacagcccgcccagcacgatgttgatgcaggcagctgggtggtgggtatcgaccagacgctggtggatatcgaagccaaagtcgatgacgcttttctcgcacgttatggcctgagtgccgggcactcgctggttatcgataatgccgtcgcggaagcgttgtacaacgagctgatgcaggaagcgctgatcacccatcagtttgctggtggcaccatcggtaacacgctgcataatttctcggtgctggccgatgaccgctccgtgctgctgggcgtcatgtgcaataacatccagattggcggctacgcctatcgctatctctgtaacacctcaagccgggtcgatcttaactatctgcagggcgtggatggcgccattggacgctgctttacgctgattggcgaacatggcgagcgaacctttgctatcagccccggccagatgaaccagctgcatccggataacgtaccggaagaggtgatcgccggagcctctgcgctggtactgacctcctatctggtgcgctgtgccgaaggtgaaccgatgccacaggcaacattgcgggcgattgagtatgccaaacgccacaacgtgccggtggtgctgacgctgggcaccaaacatgtgattggcgacaatcctcagtttctggcgcgatttcctgcgcgagcatgtcagcatcgtggcgatgaatgaagaggaagcgctggcgctgaccggcgaaagcgatccgctgctcgccgccaatatggcgctggactgggtcgatctggtgctgtgtactgctggcccgattgggctctatatggcgggttacaccgaagaagagttcaaacgcaaaaccaaccatccactgctgcctggcgcgattgctgaattcaaccagtatgagttcagccgggtgatgcgccagcaggattgccagcagccgctgcgcattttctcgcacatcgcgccttatatgggcggaccggaaaagatcatgaacaccaacggcgccggagatggtgcgctggcggcgttactgcatgacatcaccgccaacaactatcacagcctgaatgtgccaaactccagcaaacatgcgcgtccttacctgacctactcatcgctggcgcaggtatgtaaatatgccaaccgcgtcagctaccaggtgctgaatcagcattcgccgcgtctgacccgcggtctgccggagcgggaagacagtctggaagagtcttactgggatcggtaaagctggcagctgccgcgcataaaaaagcccttctgaagagaagggccttagaagactggcaacgtctggctcggttagcgatgagatcgagcctgttaagggaacacggtcagatcggaaaattgctaagccatccgtagccgggcgaactcttcgcgttgttcaaaaacgctcccggcgtttttagtacgcacctcatccctgaggtgcgcccatagctgggccaacgctttgcgttgttcaaaaacgctcccggcgtttttagtacgcacctcatccctgaggtgcgcccgtagccgggccaacgcattgcgttgttcaaaaacgctcccggcgtttttgtcccggtcggcgggacgctttcctcttctgcccgtgttccctgcgtgttgagtttattcgttgcggtaaaattcaccctgattttgatagagcagtagcctgccagtctttgcttaacacgaatcagcgcacgacatcgcagggctgtaaatcttcgccctgggtcatctcatcctgcaggatttgaagcatactgctggcgatctcacgttcgcccatcaccacgcgtgtagcaccccgttccatgatgtactcgacttcatcgtcatagtgggcgcgggcgataatctcaatattctgatgtttttcacgcgcggcggtgaccacttcacccgcttcatagccattcggaatagtcagtaacagccagcgggcgcagtcgagtcgggccagtttccatggtgtcagcgcgggctgcattacccagcaccgccttaataccgcgctcgcgcagcgcttcaacacgggcgcgggagttttcaactaccaccagcggaacattggcttcaagcagcttctgaccaatcagactgcccacccggccgtaacccacaatcaccgcgtgattgcagaaatccaccgggatctgcttctcttcttcaatcgcctcttccagcgtctgctcttccatcgtctccgttttcgccaggaaacgctccagcagggtaaacaggatcggattaagcataatcgacaggatggcggcggccagcaccaggttgcggccctcgtcagtcagcaggcccagcgagatacccagaccggccagaataaaggcgaattcaccaatctgcgccagactgaccgaaatggtcaacgccgtacgacgtgaatggccgagcagcgacaccagcagccaggcggcgaccgatttacccaccacaataatcaccagcgcgcccagcactgccagcggctgcgtcaccagaatcgacgggtcaaacagcatgccgaccgagacaaagaacagcacggcaaaggcatcacgcagcggcagcgtatcgcgcgcggcgcggtggctcagttccgactcgttcagcaccataccggcaaagaaagcgcccagcgcaaacgaaacatcaaagaattcaacagcaccaaaggcgatgcccagcgccagcgctaataccgccagagtaaacagctcacgcgagccggtggcggcgctgcgggcgaggatccaggggacggcacgccgtcccaccaccatcatcagcaccataaaggcggcgactttgccgatggtccacagcaggtcccaggccagcagtccggcgctggcgttgccctgttccatcatgccggcaatcgcaggcagcagcaccagtgtcagcaccatcaccagatcttcaacaatcagccagccaatcgcaatctgcccgcgctggctatcgatcagttgccgctcttcaagcgcgcgcagtaacaccacggtactggcggtagagaggcagagaccaaacaccaggccggtcatccacgaccatcccattgtccacgacaagcccattcccagtaacgtcgcgaccgcgatctgtgcgatggcaccgggaatggctatcgactttaccgacatgagatctttcattgagaagtgcaggccgacaccaaacatcagcagaatcacgccgagttctgccagttcaggagccagattggtatcggcaacaaagccgggggtaaagggtccagccagcacgcctgccatcaggtagccaaccaggggcgaaatacgcaggcggttcgccagcatcccaaggagaaatgccagaaccagtgctccgacaatggtagtgatcaacggtgtggtgtgatgcatgcctgtctccttgtatacaaatgtatccgcttgtaacaaatgagtttaaaacaaaatctattctttcgctgagcaatttgcgggaataccctaaaaaagcaggaaaaaaagtcaaatgcacaatcgaaagggtgtttttgttcattatccataatattggctgatttgacggtttaaagcggtccgggtaaataaaaattagcatccttaaatgccgtgggtatgacacaaataagggttaaatgcgcgcacagacagggtaaagcccgtcagcggcacttttgcaggggtaaacaactggttaacatcaggcctggctacccgttctggcttatccggaacaaaccagtctgacgctggcgcggccttgcggctattgtcatgctcagcaaaagcggtccggagataaaaagagcggcatacagagacaggcgaatgtgcgttggccttgagttcgccgggggaatgtgcgacacagtggggcaaaccggcagaaaatcgggccagacggcaaattaaggagaatcacagtgttgttatctaaatggacaggggcgggcgtggcactactggtggccctgatgccgctgttttcacaggccgcccaggccgatcgcacctatcgtttcagcctgctgcacaccaacgatgagcatggtcatttctggtttactgagcagggtgaatatggtctggcggcgcagaaaaccttaatggatacgatgcgctacgatgtgcagtccagaggcggcggcgcattgattctctctgccggtgatgtgaacacgggcgtgccggagtccgatgagctggatgctgaacccgattttcgcgcgatgaacctgattggctatgatgccatggcgctgggcaaccatgagttcgacaagcccatcgcggtcctgcgcaagcaggagaagtgggcgcgattcccgctgctcgccgccaacgtttatcagaaaagtaccggtcagcgcctgtttaagccctgggcgttattcaatcgtctcgggctgaaaattgcggtggtcgggctgatcaccccggacacggcgaaactggccaatccggcgggcctgacagataccgagtttccgcgatccgattgcggaggcggagaaggcggtggccgaactgcgcgccacagagaagccggacgtgattgtcgcgctgacccaccttggtcactatgacgacggtaagcatggcagcaatggcattgatgacgttaccctggcgcgcagcctgcctgccggcaccatcgatctgattgtgggtggtcattcgcatgatgcggtctgcatggaaaaagagaacgtcagcgttaaaaattatcagccgggccagccctgcaaacccgatcagcagaacgggatctggattatgcaggcggataaatggggcaaatatgtcggacgtggtgacttcaccttccgtaacgggcaggtgacgctggaggcttatcagctggtgccggtcaaccttaaacatcagataaagaacgcggatggcagcgaaacctggctcacctggcaggaagagatcccgaaaaacaccgccatgatgaaactgctgatgccattccagaaacgggctgaggcgaagttaaccgtgaatgtcggcagcgccgacggcaacttcagcggtgaaaaagagcaggttcgctttgagcagacgaatctcggccagctgattctgcgcgcccagatggcgcacaccaaagccgattttgcggtgatgagcggtggcggtattcgcacctcgctgaaatcgggcaagctgagctggcgtgacctgctgcaggtccagccgtttggcaatcaggtggtctcggtcagcctgaccggggcggagatcaaaaaatatctggatgtggtcgctaatattcagcctgactcaggcggctacgcccagtttgccggcatcagcctgaccgcagacggtaaacatgtcagcgacgtcagcattaacggtaaaccgctgcaggatgcgcagcattatcgcatggcaaccaacagcttcaatgcggctggcggcgacggttatccgcgtctggataatcatgcgggttatctcaacagcggggtagtcgatgcgcaggtgttgcgtgactggatcaagacgcactcgccggtcaaagccagcgactatcagccgaaagggcagattgtgcatctgaccgatgagcagatccgggcgcgggatgaagctgcggaaaaagcgcggaagcgtaactatcccaaaatgatcctggcgtggatctggccgtgggggaatgaaacagccgccacgcattgaactgaccgggaggcgcttgcgcctcccgtttttcttacgcccggcaggggtgacgtttgatccagcgctcgcgcagtttgtcccacacccagttgtaggccatggtgtagggcaggaagaagaggaaaaaggccacttcgaccaggaaagcctgacccagagagatatccagcatccaggcggcaatgggcagaccaatcaggatgaatccgccttcaaatcccagcgcatgtaatacacgcacgcccgggccacgtttctggcctggcgcatagaggcgatcaaatccgctgttgtaaatcatgttccatagcatcgcgaccgtagagagcataatcgccagcgatcccatctgaaacagcggtttattcattgcccatgccgccagcggcgaaacggtgagaatcgccagtgtttcaaagcagacagcatgaagaatacgttctttaagtgagcgggtacgcattgtgagttctccttcaataatgcggcgcattttcacacgtcagaatgctaagataaaatgaacacctatcgaaaaaagcgatggttcagatgcgttactccccggaatcccttgaggcttttatgcagactgtggcgagcggttctttctctgccgctgcgcgcgcgctgggtaaaagtcagtccaccatcagcgcggcagtagccagtcttgaagacgatctcggctttgcgctgtttgaacgggcaggtcggcagccggtcctcaccgagcagggacgccgcgttattcctcaggttcagcagatcctggcggccagcgagcggctggatgcgctggcgatacgtctgtcgcagggcgttgaaccccggctcagttttgccatgtcagacttctggcaaaccgatcatcacgagcatctgctcaggcaatttgatgcccgttatccggagattgaactggaggtcatgattgccgaggatggtgatgtgctggatctgctgcaggccgggcgggtacatctgggcgtggtgcgggcacagcccaatctgccggtggatattgccgtggcgcgactgcaggttgaagcacagatggcggtctttttacatcgcgatcatccgctggctcagcttaagaccctgagcgaaagcgagctggaaggggttcgtcacctgcgattaaatacctgggttgaggcatctgaacccgcgccaatggggcgcatctggtcggcaccgacctatctgttactgctggagatggcggagcagggatttggctggacgattctgccgcgctggctggtgaaacagtttggtcatggcgtttctgaaagagttgtcgatgccgggctggccgcagcatatcgccattgaggtggtctggtcacgccgtacgccacccggtccggcgggtcgctggatgatcgatcagctctgcgcccagccacgggtttagtcgtggcgggcgatatccgcaaacggagcgtccagcagtcgtgaaagatcctggggagccagttcgatatccagtccacgcttgccgcctgagataaacatggcgtcaaacgcgctggcagagtggtcgatcaccgtaggcagccgttttttctggcccagcggactgatgccgcccaccagatagcccgtgacccgctgcgccagctgtgggtcggccatatccgctttcttcgcgcccagcgcttttgccactttcttcagatccagttgcgtcgaaaccggcgtaatcgccactgccagctgtttcgcctcgccattcagcgccaccagcagcgtcttatagacctggcgcgcatccagattgagtttacgtaccgcttcgtcaccaaaatgggtttcgctgctgtcatgctcatagggatgcagggtgaagctgactttttgtttttccagcaattttacggcgggcgtcatacaggttccttactaagaataatcttattacgcagaatcgtggaaaaaggtggcgaaactttgttctttgagtgaaaattagccgcgcgccagcaatctgattgctgagcgataaccaaaatcataaacaaattcctctttgacgggccgataatattatcggctctctttttttcagggcttcttcagcatctcaggcaggttatcttcgccgtagagatgcagagcaccgaccgctaccacatagtttcctgctgataatccctgaagccggtcacaccactgcgcatttcgctgaccgatcaacgtatcattcagcgcctggctgaaggtggcgggcagggtgatttccggctggcgtggcggcgtatcgagccaccagctcaccatcatctgcagcaggcgcgcattggtgtgccagtgcagcagcgtatcctgcaacaacgccatgccgtcatccggcagcgcagtcagcagggcgatctgcgcctctgcgccttccagttcaatcaccggtttgttcagacctttcgcggcctgcaacagctgataatcgatgccgtagtcaggacgcaatcccagcctttgtgcctgctgcgcctgtaacatcagcgccacctgccaggcgggcagattatcaaacaggctcagattgaggctcatctcctgacagagtgcggtgagcgtttgcatcgcgtggctatccagccgggtggaaagcgcgggacgatcgccgtggtgatcaaagggtgaaccaccctgagtaatatccgcttccacaatcagtgcatccgcctgctgcaactgacgcagcagacgggcgggcaacggctgcatgtcgcgcgtccccatgtggatgctgccgaccagatgcagctgacgatcgccaagccggacatccatcgcaggccagcggtaactggcgggaaaaagttggctgataaagccgcgcagtgagcgccagatgttgcctgtcattcccggtcctttgcgattcaaaaccccatgctagcgacttcagcgcgcgaaaaacagcgctgaaacggcgattactcgcgcggtggccggtaacgcagcaggcggttagcattgctgaccacggtaatggaggagagcgccatcgctgcacccgccacaatcgggctgagcagggtaccggtcagcggatagagcacacccgctgccaccggaatgccgatgctgttatagataaatgccccaaacagattctgccggatattgcgcagcgtcgcggaagagagcgctaacgcgtccgccacgctgttcaggtcggcacgcatcaacgtgatgcccgcggtttccaccgccacatcgctgccgccacccatggcaatgcccacatcggcctgcgccagtgcgggcgcgtcattgatgccatcgcctaccatcgcgacgcgacgaccctgctgctgtaagtgttcaattgcagccgctttgccttccggcatcacgcccgcaatcacttcatcaataccgacctcggcagcaatggcgcgcgcggtattttcatgatcgccggtcagcataatcaggcgataaccctgctgatgcagtcgcttcagggctgcgctgctttctggccgaagctgatcgcgcagcgcgataagcccggttagctggccctgctcagccagtaacaccggcgttgcaccctgttgcgtcagccgcgcaatctctgcttccgccgcctggtaatcgacgccgttatcctgcattagcgcggcattacccagcagcagcgttctgccatccagactaccgctgacccctttgccgcgtattgtacgaaattgcgctaacagaggcggctgggtcagtttcgcttcggcgacaatcgcttttgccagcggatgacccgaggcgaaactccagcgcagccgcggtcgctaacactgattcacgggtggcatcgccccagacctgcacgtcactgacctgcggcttgccggcagtaagtgtgccggttttatcaaacaccagggtgtcgatttggctggcgcgctgcaaggcatcggcgtcgcgcaccagcacccccagctcggcggcgcggccaacaccggcaataatcgacatcggcgtcgccaggcccagcgcacaaggacaggcgataatcagcacggttgtcgcgatcaccagcatgtaggcaatttgtggctgcggcccgaacagataccacactgcgccgctgagcagtgcgatcaacaccaccaccgggacaaaaacggcggagatgcgatccgccagacggcccacatccggtttactgctctgcgcctgacgcaccagccggataatgcgcgacagggtggtgtgattacccgtcgcccgggcgataaattctaccgagccatcctgcaccagggtgccggcaaagatggctgcgcccggggtcttgctttgcggcaccgcttcgccggtcagcatcgcttcatcaaaccaggcttcacccgtggcgatttcgccatcgaccggtacccgatcaccggtgaccaggcgcagcgtcatgccgggctgcacttcgctgaccgaaatcagcctgtcgccctgttgatcaacctgccgcgcctgggctggcgtcagatccagcaatctttccagcgctttagaagatcgctgacgcgcccgctgctccagagcatgccccagattgatcaggcccaggatcatgacgctggcttcgaaatagagatggcgcgcctgtggcgggaaaaagtcgggccacagcaccacgctaaaggagtaaatccaggcggcgcctgtgccgagtgccaccagcgtatccatggtggcgctgccattgcgtaaactgcggcaggcactgcgataaaaatggctgccggtgacgatcatgatcagcagagtcacgatgcccagcgtcagccagacgccgtggttgtgatcggtgagcatcatgttgtcgcccaccatgccccagatcatcagcggcagtccaaacgccagggcgacagcagcctgccagctgaaacgccgcatcgcgctgcgggcgctgagctgctgcttctctcgtcgctcctgctcgtcatccaccacctgtgcgccgtaacccgcggcatcgacggccgctaccagctgctgcggatcagcgtcgcccagcaccagcgcactgcgtttcgccgagattgacgcgcgcctggctgacgcctgcgacctgctgcagcgctttttccacccgactcacgcagctggcgcaggtcatgccctcaatcagcagcatatgggtggggagggttgtttctgccggacgggaagcagtctccgttgtcagcgcctccggcggcggctctgatgctgtcaacggttcagactttggggaagcgtcagcggaagcgtcagcggaagcgtcagcggttttcagcgtcgcgtgataacccgcctgctccacggtggcgatcagcgcggccgcatctgcgtgaccggaaacctgcgcttcctgttgggtcacgtcggcctggtcaacatcatcgcgttgttccagtgcctctttgacacgtttgacacagtggccgcaggataagccgtccagtgccagagaaatagtgtgtgacataatcaactccttctgtaatcccatttgaccgattggtcattttcgattcatgcttaagcataaaccttccatcaaggggaaggtcaaggggacgaaaatgaacatcagcgacgtggcaaaaaagaccggactgaccagcaaggcgatacgtttttacgaagagaagggagtggtgacgccgccgttgcgcagtgaaaatggctaccgcagctacaacggacaccatcttgaggagctgaacctgttacgtcaggcgcgacaggttggcttcacgctggatgagtgtcgtgagctggtggcgctgtttaacaatccgtcgcgccacagtgccgatgtaaaagcccgtaccctgcagaaagcggaggaaattgcggcgcatattgaagagctgcacgtcatgcgcgctcgcctgctggcgctggcagaggcctgtcccggcgatgacggcgccgaatgtccgattatcaacaatctggccgggtgctgcggtcagcgtggctgaatacgcagcgtaatcccctcaatgccggttacgaccactgctgtgcccgcaggcagatcctgctccgcctcaacccgccagctgctgtccccgatccgcacatggccggtgcggttatgcagcgcggtatccagcgtcagctgcaacccgatcatctgactgccgcgctggttcagggcattgggtttctgacgcgcttcacgatggcgcatccagcgataccataaaaagacgcagatcagcgtcagcacggcaaacagagagccctgcgccgtccagctcaccggcacaaaccactcaatgaggccgacgatgaccgccgccagcccgctccagagcaggtaaccgctggtgcccagcatctcagccgccagcagtaacccacccagcgtcagccagaaccagtgcggatgcgcgataatatcgaccagcatcagcgtttcgactcagtgcgtgattccttcagcagttcaccgatgcctgcaatcgaacccagcagactgctcgcctccagcggcatcatcaccactttgctgttattagcttcaccgattttttgcagcgcatcggtatatttctgcgccacaaagtagttaatggcctgaatatcacctgatgcgatcgcttccgagaccatcttagtggcgttagcttccgcttcagcctgacgttcgcgcgcttctgcctgcaggaacgccgaggtccgttcaccttctgctttaaggatttgcgactgcttatccccttcagcgcgcaggatcgccgcctgtcgcaccccttcggctgtcagaatatcggcgcgtttagttcgctccgctttcatctgcgcattcatcgcgccaatcagctcctgcggcggacgcacatcgcggatctcgatgcgggtgattttgacgccccacggattggtcgcttcatccacgatatgcagcaggcgggtgttgatgctgtcgcgctgtgacagcatttcgtccagctccatgctgccaagcacggtacgcatattggtcatggtgaggttaagaatcgcctgctcaagattgctgacttcatacgcggcacgcgcgggatcaacgacctgaataaagcagaccgcatcaatggtgacgttggcattgtctttagagatgatctcctgcgagggaatatccagtacctgttccatcatgttgatcttacgaccgacacgatccatgaacggcaccaccaggcttaatcctggctgcagggtgcgggtataacggccaaagcgctcaaccgtccattgaaaaccttgtggcacgatcttgacggtggcccagaccgccaccagcgccagaataatcagggcaggaattacagttatcatacaacctccgcgttgtcagattaacgggccgagtcgcttcggcccggggtgctgccgcttagtagagcagggaatagagctgacggcgataacgcgcggcaagtgcatcgccggtacccagcgccgccagaatctcctgcagcattttacgcgcctggccatcagcggcattaagatcggatttcaggaagctgaacagcagttccagcgcttcttcattacgacccacctgatgcagctgtaacgagagtttagcagccagcccggcgttagtcgggtcagcctccagctgggattgcagctgctgaatctccggcgtatccgctgcctgtttcagcagatcgatctgcgccatcaggctctgatagcgggtatcctgatcctgcaatggcaccactttcagcaccgcttccgcttcatcgctgcggttcagggtaatcagtacgtcagccagcaggaaaccgatctcgctggactgattgctcagctgccacgcatcttttaacaacggcagcgcctccagcggtttaccttcctgcatcagcgccatcgcctgctgcgctttcagctcttcttcgcgcggcaggactttttccagcagggcgcggatcgcttcttccggctgcggtccctggaagccatcaaccggctgaccatcctggaacagatagacggtcgggattgaacgcagaccaaactgcgacgccaccctttgctctttgtcgcaatccagttttgcgagaataaactgacccgcgtactcctgcgccaggcgctccagcacgggcgtcagctcctgacagtgctggctgcgctcagaccagaagtagaacagcaccggcagctgcatcgactgctcaagggtctgctgcaggttagattcgttgatgtcgatgatagaagcttgtggtgacatggataagtctctttgcaaaaagtgttctaagaatatggggccaactggcccggcttcaagcgctattgcgcatgcctgattaatggctgcgcaaaatgcgatccagcatccagccgggcagtaaccgtttcagcaggctcattatgtgtgcgaccagtgtcaccggatagcgtaaacgcggatgtttactctcgagtgcatgacgaagtttaggcagaatggcttctggtggcagagtaaaacgtgccgcgatgccggggttacgcaccgggttatgctgttcgccctgcgtcacattgtcggtaaaacgggtctgaatcggacccggttcaatcaggctgacccggatgccgcggctgcgcacttcaagccgcaatgcatcgctccaggcttccagcgcatatttactggcggcataggcaccccggcctggtgtggagatcagccccagcaccgagctggtattaataatgcggccatcgccgctggcctgcaatgccggtaacagacgcagtgtcagctgatggacgccgaaaaagttgctggaaaactgctgttccagctgctggcgggagagggtgtgcagcgggccatagagaccaaatccggcgttgttaaacagcgccgtcagacggttatcgcagagcgcgatcacggtgtcggcggcctgatccacactttgcggatcgtcgagatccagctgcagcccggtaaagcccagtgtttccatgcgggcgacatcctctgctttacggcaggcggcgatcacccggtaaccccgcgccagtaaatcgtgagcggcaaccaggccaataccgctcgaacaacctgtaatcagaatggttttttgcacaaattcacgccttgaataagatttaataatcaataagttaagttatgttcgttaatgattttatgttgtggattgacagtttgtcgcccgcaccgggtgacagaacgggcggtaaacggggctatacagccccgcaaaaaatgcccgatttcagattttacgtctgagcagtgagaccagtgtgcttaattgacgggtggcagtcccatttgtgtgatttcagcagaatggtttttgttcagattaatttggcactggtcgatatatgactggtagtcgtatgcgtcctcgttaagtttctgtagctacagacaggcaaatttgagtccggtaatccttccattttttttgcgcatccagaaagcgccgagagtaaacgtctccggacgtttctttgctggactcttttccattaaaagggccgacattgttggctttgattctcttaactgtatccgctattagcgcatccagcgctttattgctgttgtctcttttggcagacagacagttatatgcagttggtatgtcttcattctgtttgaagcaggcgtcacgttctggccctgatgataattcagcctgcgccatagcaggtgcaataagagcgaccattagaattaagacttttttcactgtagataccttattctgtttctgtggttttcgtaggtcatgtatgtaggactacttttaatatgggctattaatgcgggcttaccttcaattgcggcctgaaacagtgctctggcattgtgaacaccctgatagaaaatatcagttacgacatctcgaattttggggtctaactgttcccatgctggggcagaattatcttttcgcattgatattgtttagagagtaagcctggacacttagagatggcaaagcggtcgaaaatctccgtcgccaccttgccgttatttagtgcttttgcatttctttacgcttttggcgcatccctgcgcgctacggctgcttaactaagggggccaggtcttttgccattaactgggcgataaaaggctgggcatcaggattaggatgaatgccatcctgctgcatccactcgggtttcagataaacctgctccatgaaaaagggcaccagaggaatgttatgctgctgcgctaatccgggatagatgccgctgaacgcttcggtgtagcggcggccatagttggcaggcagacgaatctgcatcagcagcggcttcgcattggcggctttaacatcgtcgataactttactcagattctgcgcgatagcgtcgggcgggaaaccgcgcaaaccatcgttaccgcccaattcgattaacacccattgcggctgatgctgttttaatagtgcgggcaggcgcgccaacccctgtgcagccgtatcaccgctgatactggcgttgatcactttaggtttttgctgccactgcttatcaagcaggctgggccaggccgcggtggcagacatgcgatagcccgcactcaggctgtcgcccagcaccatcagcgtatctgcagcagcaagacgcgacaccagcagaagaatcaataacaggaagggataatgccagcggaaaacattgttgaagttcatcatcttactaagtccgtcggtcagggagagcatcagttaaccatccttaccggagttgagttggttgtcaaaccagctgagaccattgcgctgattggcgagtccggctccggcaagtcaaccttgctcggaattctggccgggctggacgatggcagcagcggcgaagtccatctgctggggcagccactgcaccagatgaacgaagagcagcgtgcggccctgcgtgcccggcaggtcggctttgtattccagtcatttatgctggtgccaaccctgaatgcccaggagaatgtgcagctgccttccctgctgcgcggcgacagcgaccgtcagagccgtgaacaggcgaaagagcttctgacgctgctcggactgggtgaacgtctgcatcatctgcccgcccagctttcaggcggcgagcagcagcgcgtggcgctggcccgcgccttcagtggccgtcctggtctgctgtttgccgatgaaccgaccggcaatctcgatcgtaaaaccggtgaccgcatcgccgatctgctgttttcccttaaccgcgatttcgccaccacgctgattctggtgacgcatgacgagcaactggcggcgcgctgcgatcgtcgcctgcggctgcgcgacggtaaattgtgggaggagcaatgatctggcgctggttctggcgcgagtggcgttcgccctcgctgctgattgtctggctggccctgacgctggcggtcgcctgcgtgctggcgctggggtcgatcagcgatcgcatggaaaaagggctgaatcagcagagccgtgattttatggccggcgaccgtacgctgcgcagcagtgatgcagcgccagaagcctggctggcaaaagcggctgaaaccggtctgacggtgagccgtcagctgacctttatgaccatgacctttgccgatcagtcaccgcagcttgcctcagtaaaagcggtggatgatcgctacccgatgtttggcacgctgcagacgcagccaccggggctgaggccgcaggcgggaactgcgctggcggcaccgcgcctgatggcgctgctgaacctgaaagtgggcgacacgctggaagtgggtgacacccagctgcgcatcagcggggaggtgatccaggagccggatggcggctttaacccgtttgagatggcgccgcgtctgctgatcaatctggcggatgccgccaaaaccggtgcgattcagccaggcagccgcatcacctggcgctataagttttccggtaatcccgatcagctggacagctatgaccgctggattgaaccgcaactgaaggcggaccagcgctggatcagcgtggagaactcggaagatgcactgggccgttcgatgcagcgggcacagcagttcctgctgctctcggccttgctgacgctgatgctggcgattgcggccgtggcggtcgccatgagccactattgccgcagccgctacgatctggtggcggtgctgaaaaccctgggtgcgacgcacggcgcgttgcagcggttgatcatcggtcagtggctggctgtgctgctgctggcggcgattgccggtggtctggtggggcagggcgtggaagcgatcctgatggcgatgctgaaacccgtgctgcctgccagcttaccggcggccagcgtctggccatggatctgggcggtgggctcgctgtttgtgatttcgctgctggtgggtctgcgtccctatcgtctgctgctggcgacgcagccgctgcgggtgttgcggcgcgatgcggtggcgaacctctggccgctgaagatctatattccggtgatgattgctgttgtggtgacgctgttagcgctgctggttggcggcagtaaaatgctctgggcgctgctggcgggtgtggtggtgctggcgggattgctggcactactcggctggggaaccctgctgctgctgcgtcggctggtagtgcgcaatctggcgttacgactggcgatcaaccggctgctgcgccagcccggcatgacgctgagccagcttgcggccttttcgctgtcgttcatgttgctggcgctgctgctggtaatgcgtggcgatctgctggatcgctggcagcagcagttaccggcggatagcccgaacttcttcctgctgaacatgacggcagatcaggtgccgcaggtgcgtgatttcctgcagtcgcatcagatcacgcccgggaccttttacccgattgcgcgggtgcggctcagtgaactcaacggcaaaccggccgatccgaagctggataatgccctgaaccgtgagctcaacctgacggaactggccgatcgcccggatcataatccgctggtggcaggcaactggccacctaaagcgggtgaagtgtcgatggaagtggaactggcggatcggctggggctgaagctcggcgataccctgacgttcgacggcgatacgcagaccttcagcgcgcgcattaccagtttgcgtaaagtggactgggaaagcctgaagccgaacttcttctttatcttcccgccgggcgcgctcgacagccagccgcagacctggctcaccagcttccgcatggaggcgaatcctgttctgctggcgcagcttaaccgtgcttttccggcgctgagtctgctggatatcggcagcataatgcggcagatcggccaggtgctggcgcaggtcagccaggcgctggagatcatggtggtgctggtgactgcctgcggcgtgttgctgctgctggcgcagattcaggtcggtatgcgccagcggcgtcaggagctggtggtctatcgcacgctgggtgccggtaaacgcctgctgcgcacgacgctgtggtgtgagtttgcattgctcggcgtggtctccggcgtggcggcggcgatgggggcagaagcggcactgtggggattacagactaagattttcgacttcccgtggcagcctgactggaccctgtggctggcgctgccgttgtgtggcgcactgctgttatcgctgtgcggtggctggctggggatccgattactgaaagggaaggcgctgttcaggaagtttgatgcggcgtgagttagcacccgtagcgctcgacggtaaggtgctggctcagggagcatacgccctccgcaaaaacgccatccatggcagactcagcgcgggcgattacgctccccatccctgaggtgcgcccgtagccgggccaacgctttgctttgttcaaaaacgctcccggcgtttttagccgggcggcccgatgctttgctccaggcgtatgctcccatcacattaaccttctgagctgcctggtaaagccattaccagactcaggtgcggaggattacagtttttcaaccgcccaggcgatgccgctggcgtacgcttccggtagctgcgtcaccagcgcattaagggcagccctgagccgttctgtatcgctgtcggtcagattcagatggcccactttacgacccgggcgcacctctttgtcataccagtgcagatgcaccagcggctgctgcagccagctgagattcacgtcagtgccaatcagattgaccatcgccgacggcgcaaataccaccggctgtggtaatgccagaccaagaatggcgcgcagatgcagctcaaactggctgattgacgcaccgttctgcgtccagtgcccgctgttatggacgcgcggcgccagctcattgatcagcaatccgtctggcgtaatgaaacactccatcgccattacgccgacgtaattcagttcctgcatgatcgcactcagcatcgcttcagcctgctgctgctgtgcctgatccgcctgcggcagcgcgacgctggtgcgcaaaatgccatcctgatgcaggttatgcgtcagcggatagaacaccacctggccatcgtgaccgcgcgcccccaccagtgacacttcaccggaaaagttgatgccctgctcaacgatgcattcgccgtagcacgcctccggcagggtgtgagtctcatcggcacgcagacgccactgaccccggccgtcgtaaccgccggtgcggcttttcacaatcgctaactcgcccagcgagtcgaacaccgctggccattcgcttttatctgccagcaactgccacggcgcggtggccagtcccagctgatccagcagctgtttctgcgtcagacgatccgccagacgcggaaagatatcgcggttaacaaaggccggatggctggccagctcacgcgtcagcgccgtctccggccagcgttcgatttcggcggtgatcacgctgtcggcgatagggagcgcggcaggatcggcgtctaagcccaccggatacaccgcgatgcccaggggttcacccgcctgacgcagcatacgacctaactggccgttgcccagtacgcaaaccggcttcatgcatccacccgcggatcgggatggttcagcacctcatcggtctggctctgacgccaggtggtcaggcgtaacgccagcgcactgtcatgcagcgccagaatctgcgccgccagcagcgcggcattggctgcgcccgccttgccaatcgccagcgtaccgaccggaataccgcgcggcatctgcacaatcgaatagaggctatcgacgccgctcagtgccgcgctctgcaccggcacacccagcaccggcaccagcgtttttgccgccagcatacccggcagatgtgccgcgccacctgcgccagcaataatcacctgaagacccttgtcggctgccgtttcggcgaagctgaacagtttatccggggtgcggtgcgcagagaccacttcaacatcaaaagggacgtccaggctggagaggatttcagcggcgaactgcatggtggcccagtcacttctggaacccataacaatggcgatgcgggccggggcgttggatgacatggggtcaactcctgtgaatgaacaaacagacctggccgggcggacaggttttgaagggcaccgagaatagcatgagaagcacgcaaggaaaacggttgcgtcgggcttaaggtcgtggatttaaccgcagattaaaagtcgaaatggatgagctgaatgccactggcgtcgagctggatcatggaaccccggctgtgccaggcacccagcactgcgcgttgcgccgtttcaccctggaggctcagcgtatgaatcgccgggcgatgagtgtgaccgtggattaacagcggcacctgctggcgcagcatagtggcgacgaccgcttcctgattcacatccatgatggtctgggatttatgctgattggcctgtttactgtcggcgcgcatccgggcggcaatgcgtttacgtatccataacggcaacgcgagaaacagccgctggatccagggattatgcactttggcccgaaaacgcaggtaacccgcatcgtcggtacagagcgtatcgccgtgcatgatcagcaaccgatggccgtagagcgtcagcacctgctcttccggcagcagcgtcatgccgcaggcctgcgcgaaacgccggccaatcaggaagtcgcgattgccatggataaagtaaaccggaaccggcagggcgcgcagggcgcgggcaacctgctgatgcagtggattaggatcgtcgtcgccaatccaggcttcaaacagatcgccgagaatatagagcgcgtcgcagtggggcgcttcgcgctgtaaaaaatgcagaaaaccggcggtaatcgccggtttcttcctgacacagatggagatctgcgataaacagcgtgcgcgacattactcgctgacggtcactttctggataacgacgtcgtcttttggcacatcctggtgcatgccgctgcggccggtagagaccgctttgatcttctcgaccacatccataccttcaaccacttcagcgaacacgcagtagccccagccctgaacgctttcgtcacggaagttcaggaagtcgttgtcagctacgttgatgaaaaactgtgcggtcgcagagtgcggcgcagaggtacgtgccattgccagcgtacctttggtgtttttcaggccattgctggcttcgttctgaatttcggctttggtttctttctgcttcatgcccggctcgaagccgccgccctgaatcataaagccgttgattacgcggtgaaaaatggtgttgtcgtaaaaaccttcacggcagtaatccaggaagttctttacggttgccggcgctttatcatcgaaagttttgattacgatatcgccatggttcgtctggaaagttaccatttttgtcgtcctgtaaaggttgtcatcagttgctgaggtcgctctgtcgattggcgtccccctttttgtcgaccgttcttatatcataatttccaatgacgcgtcagcagcgcggcgcagttggcttgctttgcgtcgcgcgagcgataaaaatacggcacaatgtctggatacttaaaagtgccaaccacacgcgaaaacggaaccgttcaatgcttaagatttataacaccctgagtcgacagaaagaggaattcaaacccattcatgccggtaaaatcgggatgtatgtttgcggcatcacggtgtatgacctctgtcacattggtcatgggcggacgtttcgtggcgtttgacgtggtggcgcgctacctgcgttacctcggttatcagcttaattatgtacgtaacattaccgacattgatgacaaaatcatcaggcgcgccaacgaaaacggcgagagcatcgaaaccctgactaaccgcatgattggcgagatgcacaatgacttcgccgcgctggggattctgccgcccgatgaggagccgcgcgctacccgtcacatcgctgagattatcgagctggtggaaacactgatcgctcgcggtcacgcttatgtggcggacaatggcgacgtgatgttcgatgtgctcagcgacaccgattacggcgcgctgtcgcgtcaggatctggagcagttgcaggcgggcgcgcgtgttgaagtcgccgacgtgaagcgcaacccgatggacttcgtgctgtggaaaatgtccaaagcggatgagccagcctggtcatcgccgtggggcaacggtcgtcccggctggcacatcgagtgctcggcaatgaactgcaaacagctgggcacccatttcgatatccacggcggcggctcagacctgatgttcccgcaccatgaaaatgaaatcgcccagtcgagctgcgcccatgacggtccttacgtcaactactggatgcactccggcatggtgatggttgatcgagagaagatgtccaaatcgctcggtaacttctttaccgtgcgtgacgtgctgcaacattatgatgcggagacggtgcgttacttcctgatgtccggtcactatcgcagccagcttaactacggcgaagataacctgaatcaggcgcgtgcggcgctggagcgtctctatacggcactgcgtcacaccgacagcagcgtgcctgcccacggcggcgaagcgtttgaagcgcggttccgcagcgcaatggatgatgatttcaacaccccggaagcctattcggtgctgttcgacatggcgcgtgaagtgaaccgcctgaaaagtgaagatggcgcttcagcgcacgggctggcgtcgaagctgcgcgagatggccaacgtgctgggcattctgcagcaggatcctgagcagttcctgcaaagcggcgcgcaggtcaatgacgaagaggttgccgagattgagcactgggtgaaagcccgtgccgatgcgcgcgccgccaaagcctgggcggaagcggacatcgcgcgcgacaagcttaacgcgctgggtgtcatcgtcgaggatgggccgcagggctccagctggcgtcgaaaataaaccggagagggcgagcaatcgcccttttttattatggcgattgaacagattcagatccgcggcttccgctcaatacgtaacctgacgctgtcgctgcagcagctgaatgtggtgagcggtcccaacggctgcggtaaatccaacctctacaaagcggtgcggttgctgcatgaggcggccagcggtcgtctggcactggcgctggctgaagaaggcggcattcagaaagcgatgtgggcgggcggcttacgtcggggcgatcgccgacacgatccaaagcggctggagctggccgtggtgatggatgatatggattaccagctgaagattggctttcccgagccgctggtgaccagcctgtttaatctcgatccgctggtgaagcaggagcgactctggctgagcggtcagcagcgccgtccttccgcctgtattatgcagcgcgaaaatcagactgcctttctgcacaacgttgagggcgagcgcgtcgcctatccggcggtgctgcatcccgaagagtcgctgtttggtcagcttggcgaaccgcatcgctatccggagctttcgcagttgcgcgaaacgtctgcagcagtggcgcttttaccatgagtttgcggtctggcctggctcaccgatacgggcaccgcagattggcgtgcgtgcgccggtgctgagccatgatggcagcaatctggcggcggcctgggcgaccattgttgagcgcggtcattccgaactcctgtctgaggtgatggaacaggcgtttcccgacagtcagtttgatgtcgatgtgcagaatggccgtttccagatgctgatgtcgcgccagggcattctgcgtccgctggagagcgcagagttttctgatggcacgctgcggtttctctgtctggttgtcgcactgctcagcccgcgtccgcctgcctttatggcactgaatgagccggaaaacagcctgcatgaagatctgttgcctgcgctggcgcgcttaatcgccgaagccagcgagttcagtcagctctggatcaccagccattcaccccggctcgcgacgttgatagcgcagcatacggcggtgaatcatattgcactggaacagcgggaaggggagacatgcgtaaagggggatgagcgggtgtaacagcgtccccgcagggacgcccggaaatcactcgaccacagtaatgcggaaacccgcgaattccacggtctgaccagctacgattttgcagcgcttgcgggtttctactgcaccgttgaccttcacttcaccctcggcaatcacgactttcgcctgtgcgccgctctgaacccagccttccagtttcagcaggtcacacagatcgacgtgcgggaatttacccagtgaaaaacttgtcatttatactacctctttatcatgaaactcttcgcacgcctgcagcgtgttttgaatcagtgtagctactgtcatcggaccaacaccgcccggcaccggggtaatgtaggaggcgcgctcggatgcactatcaaaatcaacatcgcccaccactttgccgctctccagccggttaatgcccacgtcgatgacgatggcgcccggtttgatccagtcacccggaataaacccgggcttacccactgcaacgaccagcagatcggcatgctcaacgtgatggcgcagatctttggtaaagcgatgggtgacggtcgtggtgcagcccgccagcagcagttccatgctcatcggacgaccaacaatgttggatgcgccaaccaccacggcattcaggccgtaggtgtcaatgttgtagcgctccagcagcgtcacgataccgcgtggcgtgcagggacgcagggttggcgcacgctgacacaggcgaccgacattataagggtggaatccatcgacatctttatcaggcgtgatgcgctccagcactttgacattatcaatgccggctggcagtggcagctgcaccaggatgccatcgatttcgtcgtcctgattgagcgcatcaatcagctccagcagctcagcttcgcgggtcgtggcaggcagatcgtaagagcgggagtggaaacccacttcttcacaggcacggcgtttgctggccacgtagatctgtgatgccgggttttcacccaccagaaccactgccagacccggcgcgcgttttccggcggccagacgctgcttcactttttccgcaacctcaacgcgcacctgctgcgcaatcgttttaccgtcaataatttttgctgccatcagagaggaaatccactgtgttgtgttgaatcggggaagggggctattttgtcagaagcgcggcgcgctgtcagttacagtttcagccgcgtatgtgctttccggctttttcgtcgcgacgagtgccagcctgcatgcgtatgatatctgcaggacaatccggggacgatgtaatgatttggataatgcttgctactctggcggtggtgtttgtcgctggatttcagctgctcaccgctcgctcacgccacgccgctcagcgactcagcaaacggctgcagctgccaccggtacaggtggaatcaatgatctctatgatggggaaagaggcggcgaaagagtttaccgactatctcagcaaggataatgaaacgcacctgcataatggcgcagcggtactgctgatctggcaggtgttcattgttgacggcagcgaggagaaacagccagcgatggcatgcgattctcagtcgtgccggttttccacccctgattaaccgccagcagctgctgctcgcgctgggctttctgcgccagctggagccggacatccaggcgctgcatgcacttcgtgagcaatacaatgcgcgtttcacatcacaagggattgagctggaaggagaatttaccgacaacagtaaactcgtgtcgctcagcgaatggcgcaggcgtcactgacgccaattggtcattaccgcagcacttcgctgcggagaaacggcaaaaacgttgacgtacccgcttcccgacgtataatccgtgccatctccatgcgcccttagctcagttggatagagcaccggccttctaagccgtaggtcacaggttcgaatcctgtagggcgtaccattttttcaagtcaacacacttctactgaactctctttctttgcttaataatccatgatattgatagtttttttggcgcgagctgtttcaaagtccactcagttatacctttaatcaagtggtacctgtgaatttttaaggggtttaatttcgtttaatggaaatttaagagctctttatgtcacaaaagacaggacaaatttacactgcaaaacctaaagaaaatgaatatgtgtttactaacggtgataacttagatctatcagcaactcctaagtatgctatataattgtctttaaagtaagataagggggaaattacaataagcgcacacatcgatatttttccatcatatgcacactgaaggttgatgcagaatttaaagtggttagtttaggggaaagaatagcagaagaaaaagaatcttaaaaactggagcaaagatttaatgtcgaaaaatacagatatagatattattctaaaaggaatgagtataaacggtctggttgggtgaaatcatatgcttaatatttataggaatatatagtaaccatacctatctcaaaattgtgaacataaattttaaaatttaaaaagtggaaattttcctaacgtgagtaactgccggttcaacgacagttgagcaagtgcgttgtacaaaatatgtctaattaaatccccatgttaccacattcttttaccccctccgctacagctgttcaaaccagagtaagtatccatttagtttttatataataaacgatttattgcattatgatgcccacgtgcgcatagcatcatgctttactcagttttgatgatgattaggcttctttgcactacgtaacgctattaatatttttaatgggttaggggcgggcatttttataaaaatcaagatttaatttaattaaaaccgtcaaggttggagtgaaaatttttagtcttatgatttataatggtaatttgacttgccctgatttctaaattacaatttgtatgctctttagcgtggtatggatttcaccactcaacggttaaatctagttcggcgttacgcagaactctaacttattgattatatttacagttgcggaacaaaatttctgaaccgcagccgtagttgcggatcagaaattttgttccgcggctactagtaaagagcagagcaccaaaggtaggggtatgccttgtcgtacccctacctccttcctgctccttcatacctctaatgagccagttttccacttgcttacaatcaaggtagtaacttgcgatgatcattgatttaaaaggtgaactttcagagaaagtggatgatctacagcagctactcaaatcacgcccttctactcactataaagtttataaaatacctaagaggagtattggatttaggttgattgcccaaccaactaaaaaattgaaacatatacagaaattaattgttgacttgcttttgaacaaagtaaaagtacataaaaatgcaacagcctacattaagggtaaaaacatatcctttaacgcctctatccataagaattctgagtatctattaaaacttgatttagagaacttttttaatagtattaagccgggtatgtttttcaaggaacttgaaagacaaaatattcgccttagcaatgaagatactgcgattttggaacaattttgcttctggaatagatctaaaagaaaaaatggcgctttagtgcttagtgtgggtgcaccaagtttctccatttatatctaatgtattaatgtatacgtttgatcaggaattatatgagttttgtgcatctaaaaaaatagcttactcaagatatgcagatgacatgacgttttcaacaaaagaaaaaaatgtactcctatcaatacataaacatgtggactttttgctaattaaatatttttctaaaaacttaagaattaatgacttgaaggttgtatattcatccaaagcacataatcgacatgttacaggtgttacattaaccaacgataatgaaatctcaatagggagagacaagaaaagattaatatcggctatggtttataactttaaaaataattcgcttggtttagatgatactcacacattgcaggggttaattggctatgcatttagtattgaaccagattttataaaaagacttcaagctaagtatgggtcaactatacttgaagatattaacaaaaaccttttgaggacttaatttatgaataaaattagtagcaccataaaaaagctcatcaaaaaatcagaaaatggagactttgcttcttcttatcaactttataaagtgtatagcgaagggcatggcatttatgaaattgatagcgaattagctgaaaaatatcgtaagcattgtgtaagaaatatgtctcatggtcagcttagagttattaaaatacaactagaaaattacaaaggttttgaaaatatcactcttgatttttctccagaagaaaaaatagctgtttttgttggtaataatgggtcgggtaagtctacattattagaagcgctgcaaaaggcgatgactcatgtatcatcgcggtttgcaacacgctcaaacaatggcgatctcatagaaagatttgaaataagaaaaggaagtggttattcgagaataacagtgacttatagctataatgatgtcagttttttaatggttataggacaagataatttaacagatgatcctaaagggaaaagcaactattcaggaattaatgagttaggtcagttgtttaaaaatgctaattctgtggatcccgcatttaactatccattgttagctgcatatactgttgaaagagcgaatgatgtgaccactaaggatattgaaaactcagacgaaataaaagaatctcaatcgtgggataaatttaaaggatataataaaagtcttacggggaaagctgattttaaattattttttaggtggttgaaagagttggttgaaattgaaaactctgacaatgttgagcttaaaatgctcaaaaaagaaattgaaaataaagagaaagaattagaaaacccacttttgaaagctttagtttcagaacatcctgattccaaaacaacaaagcaattattagagcaacacaatcttgtaataaatcatttaaaagaaaagttaaatagctattttgatattaatagtaaaacgctgcaaacagtggaaaatgccatatattccttcttgccaggatttagtgaattgaaattacagagatccccactagatcttttgataaagaaaggggatgaatctttcagtgtgttacaactctcgcagggggaaaaatctattttatctttagttgctgatatagctagaagattgacaatactcaatccatcactcgaaaatccccttttaggcacgggtgttgtttcttatcgatgaaatagatttgcatttacatccatcatggcagcaaaaaatagtacaaagattaaaatctactttcgaaaatatacagttcattattactacccacagcccgcaagtttgtcatactattgatggtgagaatattttccttcttaaagatggtaaaagattcaaagctccaagaggtactcgtggagcagtgtcatcttgggttttgaaaaacttatttgaagttccggaaagaccagaacatgatgagtttactaagaaacttgaagagtataaaaataacgtctattcagataaatatgatacagctaaatcaaaaaaattatacttagaattgtctaagcattttggtagtgattatgatgttctagtacaactgcaattgtatattgaaaacagagaatgggagaaagagattgagaagcataattaagtcaaatgaaaaaatagttttctctcaatatagaatttcccagccaaacagcacatgggatgaatttaaaaattttgaaagaggaaacgtctataagttaattaagaatcaaatttttgatgatcaatttcagttgtgtgcttattgtgaaacatcagttccaaaaacacctgaaaatgaaagaagaattgaacattttagatcaaaatctggctgtgatcctaaaattgataactggcatttggattggatgaatcttctgggggtttgtgttggaggctcgaattgcaaagcagaatatgaacttccgctaaatctaagctgtgattcgcataaatcttattatgaggaaactcataaaagagaaactaaagattgggtcggcaggattttgttgccactttcattgcctcctgaacacgagctttttatgttcgataaaaaaaacggaaatcttcttcctaataaaacttattgtgatggttttgagtttgaaaatcatactaacgttaatattgaagaattagtaaaaaaaacaattattgtacttaatcttaattgtgaaagactttgtaaagcacgattagttatgttgcatgaatttaatcgttctttagctaattataggagtacaaataacattacggtttttagaaatctggtcatccggtggtcaaaaggaacgccaagtttttttcaaacaacaagattgatgttattaaaagacagctttatagcaaaaaaaataatggaaggaaaagattgaagactgctgatacaactctgctataatcaaaatttagaaaataatccactaaatcgcaagggggagagaatgaatgaaggttcaattggacttgaaatgataattcgttttaaccaagaaaccatagcctgtaagcttagacgcctgcctttcaactggtgattaaggtagggtaattcaaatgagtgaagagctcatatgctattgcttttagcatatatccagcaaggtttaattaaattaattattggcataattggatagggaaccgagtttttttctgtctcaatctataaaagtgacctctagggaatattaagatttaactctaaaaatattaacaaaagcaggttgttgatatcattgttaattaaaatagagcgtaagaatatatttgtattttaattttctttagataaaaataatgtctatataagctttgtaatatgtggtgtgaagaatttcgattggctggataagtgtttttattgaatttaatccagaatgtctgaccaaataaacagggtttatataaataatagattattagcgctcatgcctcatcatcattcgttaaaccacccaacttgagtctgccgctccccaatcagaagcggcatccttttacctcaacgccactaacccgcaaccacacccgacaaagccagaaacctgcttctgtttcctggcgggcagcttattcagctgcgctaacgcgttaaccagctgctcatcgaccggctctggtggtttcacggtcagcacaatacggcccgctgtgacttttacttctacttcggtgccggtggtaaatccggcggcagccagccactggcctttcatgataatcgatggaatacgcgcgtaactgggataccggctggcgtaactcaccgttaatttgcgctgggaaacggaaggggcttctgaatttaaaccaactgcattacactctgactcagtcatgatctctattctcgctaaatagtggttgtgattagcgatacaggggtgctccaacacctctgtatcgcgctaaatacctgtacatataatcaactattgcaggaaaagtccagctgaaaatcgatgtaaatcagtgactttaatcatctgataaacagcgaattttacgatgacgatctcaaaaaaatgcaattaactgaaagcattcattgttcggaatataagaaaagtcacaggtgatatctcgtcataaatatctgccattagccgtattcagtaagcccgctatcagtaacaggtgcttaacccgcagtgtgcttaagcagaaagtcgattaacgtttttactcttttcgttttacccgcgcttttaggataatagagataaaccggcggataagttttccagtaacgctccatcaccggaataaaagcctctttatccggctgtaaattatgaaccggttcaaacagtcgcccgatacccagcccgttgcgaatgccatcagccatcacctcaatatcattactcatcaactgacccggcatctcaacggtcagctgttcgccatgatgatccagaatcagcggcagaatacgattattggtgataaaccggtaaccgataagccggtgctgatgcaggtcagacggagactctggaataccgaacgctgccagataggcagaagaggcatacaaaccttcgcgaaacggcttcatcagcgggcgcgccaccacgccaccttccagaatgtcgccaaaccggatccccagatcaaaacgttcatcaatgatgtttacggtgccatcgtataccgaaatttccagctgaataccgggatattgctggcagaaagcggccatcgcaggtttcagcaccagcagataagcaaagcgcgaaagggtgattctgaccagtcccgacggttcctgattctggtcacggatgctttccagcgatttttccagcgaggctaccgctgctgaggtttgttccagcagctgctgtccggcatcggtcagctcaatacggcgcgtggttcgcacaaatagcggatgaccgatgtgcgcttcaagcagcttcagcgccttactgacagaggggggagtaatctccagtttgcgagcagccgatgaaatatttccttcgcgggcaatgctctggaagatgcgtatctgattatagatggcgttgttcacgggataatcctgacacaatcgggctgcttattattagccgcaggctaaatatctttgagtcaatagtggcctaatcttcactaaatcgcgagcatatactccttatcagttccccctggccgtgaatctcaggagattgctatgcgaattttgtgtctggataaacccgcccccgatgccacgctggaaaagtatcaccctcatatggctgccgaagctttccatgcctggagtctgtataaatccggtgcgctacgcgatatttactaccgacaggatcgacccggcgttgcgatcttccttgaatgcgactcggtggaacaggcccaaagcctgctggctgactttccgctggcaaaagccggtctgctgagttttgactgcatcccgttaggtgcattcaccaactgggaaagcctgtttcgctgcagagtataagcctcagcaagagggcgccacccaatgatcagtcgcaaaccgctaccgtgtgttgtcaccagtcatccgacaggtgtcaggcaggcggcgcagtaaaaacgccgcgtgaagcgctaacggcaggaaaggcggaagccgtatcggtgggttttgattaaacggtgccggacggcaaaaagtacccagcgcgtgatggcatcgccaacgcctggctatctgttaaaaaaataaatgattaaaaactgaaaatgaaaaatatattaattatttccggtcatcctgacctgagccattcggtcggtaacgctaccattcttaatgaagtcgcttctgcgctgcctgatgctgaaatccgtcgtctggatgcactttatccggacaacaacatcaatgtcagtgccgaacaggatgcgctgctgaaggcagatattatcgtctggcaatttcccttctcatggtattcgctgccagggctcatgaagttatggctggatgacgtatttgttcatgggtttgcgcacggatcgacggccagactcggcggtaaaaaactgatcctctccttcaccactggcgcaccgcaggcgttatacgcggcagatggcgtctttggtcatcagctggaggattatctgattcagtttgaaaccaccgcccggctctgcaatctggagatgcagaaaccggtttatacctgcgggataagctatgccagtcgtaatgaaactattatcacgcagcaaattgctgcagcaaagcaacacgcgtcgcgactcattgctcagctcaatgcggaactcacgacggcttaatagccagatgaaacagaaatcgcgccggttaatgcaccgaatgaatcgcaaatcacctcatccgataattaaggcagaccgtgaacaatattaccgctctgactctgactctgctgatggccggcccggcatcggcagccgctttaacagaccccacaaaccgtgtcattaatctgcatgaaatggaaattaaggccgggaaaaacggacagtacgatgaagttgccagagataatattacccgttcgctggcagagcaaccaggtacgctggcgatgtattcactgaaacataaagaaaatgctcatcaggcttatatgattgaaatttatgcgagtgaagaggcataccagcaacatctcagttctgagccataccggtcttttattacacgcgcacctgatcttatcggccagaaaaagagcactgtgctggagccgcagtttctgggtgataaacccttcgtacagaataaagaaaccatcaataacctggtgattgttgacgtgaaaccggccgatcagcaggcattccgcgatattgtgctgcctgaaatggcagagtcactgaaggtggaaccgggcgtactggcgatgtatgccgcgaccgatgcaaaaaacagatatcgctggttcttctatgaaatctacgccagtgacgccgcctatcagcaacaccgcgaaacgccccattttcgcgactatatccggctgacagctgagatgaccgaccgcaaagaggcgatccccgtgttgccagctctgctgaaaaaccgtggcgctcttaactcttttgttaactgacctttaccagggagctgatcagaggatgaaaaaagtgattgccgccgccgcgatctccatgatgctggccgacctggccgctgctgaacccaaaagaggtgaaactatgttgaacgtcaatccatccagcctttcggttgccgacattgagtccgtctctcccgcactggctcgtttcggacgtgaagcgataactgatgatctctggaaacgcgatgcactttcgatccgtgaccgcagtatcgtcacgcttgccattctcatcgcccgcaaccagcctgctgagttacaacattacgccggtgtggcgctcgacagtggcgtgacgcctgctgaagtctccgaaataatcactcacctggcgttctattccggctggcccaatgcgatgtccgcaattgcggtgaccaaaaatgtgtttcaggcgcgaggcattggtgccgatcaactggccgaagcctctccggcactgctgccactgaatcaggcagctgaacagcagcgttctgcaacggtggagaaaaatgtggggccgatctcgcccgggctggtcagattcaccgccgatccgctgtttctcaatctgtggcagcggccagcgctacagcctcgtgacagaagtctggtgacggtcagcgcactgattgcttcgggacaaagtgcgcaaattagctaccatctcaaccgggcgatggacaacggattgacggctgaagaagcgggcgagattatcactcaggccgcgttctatgctggctggccaaatgccttttcagcggttccggtggtgggggaagtactgcgggatcgcgcagcaaaacaggaataacccgcagcgggtgaggctctcaggtttgacttcacccgccgtttcttatgccagccggataccgacagagatccggaaaagtgctgtgccattctggtggtttttcccctcccgccgcaatgccatgatgaccgctccaaaccttccacttacaaccacccgccattgggcataaaaacagagagcaccgcgtcatggaaagtaaaaatctgacagatattgctgaagacgtttcatacggtgtgaaatataaagcagtaataaatgaaggatgggcagggcaggacgcaggagttatttaacagaataaatgaaataagccgtggcgggcgccacggctaatgttttatgcagactgccactcactttcaacatccgctttggctttagaaaggatgactttattatcatcaacttctttcacccagctgaatggaataatgtggtgtttgccgcccgcttcaggatcgcttttcgccagcttaattttgtcgtcgccttcgaagtggtcgacaatcccgacatgttcgccattcacatcaacaacctgcgcgtgatctaaaatttctgatttatctaccatggtggcttaatccttatatttaatgagttcagttgccctcagacaaaacaagcctggttgttaaatgctgttttcgccaggggattaacaaaatgaaatagttcagtgaactggacctggtcgcagttatttatttccggcaggagaataaagggcatataagcgaaaccgcaaacagagtcggagtatctgcagccacgggtctgctgacctcactgcctgccacatcgacaccatcagatttgccgcaatcgtctgccgcctgttcaccaatcaacgctatgataatcaggtcaatcgccacgccgcagatcggccagcacgcgggcggtttaacttacccaaaggagtgcctatgacagcagtcagttccattaccactgaaggtggcgtctggattaatcagccgccggtacacagcctggatggcgaaacgctgaggttcgaaaccgcgctgaacagcgatttctggcagcgtacctggtatggcttcgaacggcacagcggccacgcttttggcttctgggtggaaaacgactttaccgttcaggtgcaggtgagggcggatttcagtcagctctacgatcaggccgggctgtttattcaggataacgaaacgcactgggttaaggcgggcattgagtttaacgatgaccagcccgcaattggcagcgtggtgacgcgcgagttttccgactggtctaccggtgtgtttcccggcgatgcgcgccagtttctggctgcgcgccacgctggaaaacgcggccttaagaattcagtactctaccgacggcgtgagctggccgctgttacggctctgcccgtggcccggtcaggcgcggcggtttgtcggagtaatgggctgctcgcctgaacgtgaagggctggcgatgagttttacggacttcgctattactccaccgctcggcaaagcactgcacgatctctcctgagccaggcggcgcattgcatatcgtcgcagaatcggcttaattgtcaggtcagaatttgcggtgacgcgtcgcccgtgcaagacgacgcctttacagggaaagctatgcgttgcgccacctcgtttatcccgctgctggtcatcagttgctgcgccggatggacacagcaggccactgccgataccgtctggctgaataatggcgatcggctgaccggcacgattcgttatctcagcgacggcaagctggcgatagagacacactacgccggtaccgtcacgctggactggagtgcggtcagtacgcttgccagcgagaatccggtgaatgtcgaaaacaaaaagaccggcgaacattatcaggtgcggctctcctcatccgatcccggctatgtctgggtggaacgcaacgagcaggagcagcaggtctctctgcggcgcattgatgagtttatgaaagccaaagtccgcagcgatcagctcgcctggaccggcaacatcgatgcgggcgtgaaagtcaaaaaagcctcgaccaaaactgacgactacagcttcgcgctcaacacgaaactgaaccagggaaaatggcgtcacgatatcggtgcgacctacaatcgcgagcaggaaaacgagaacatcaataccgataactacagcctgcgctacgccttcgactatctggtcagggagcagttcttctggcagacccgcgccacctacaagcgcgactgggtggagaatctgtcacgtcaggcgctgatcggcaccggtccgggttatcagttatgggacaccgaactcagcgcgttctcactctcggtgctgggcggtgcctttgagtatggctacagcgatgaccgggaagagcggcactttggcggctcgctgcgctggaactatcagcgctatctgctgggcaagtcggtcacgctttacagcaatggcgatgtcggccattcgctggatgatgacggcgtatttatgctggatgccgaagtcggcctgcgctacagcctgacttcgtggtcaacgctgcacgttggctatcaccgtaatctggtcagcggcataccggataccctgaacgaaggcattttctctaccggattggggctgaagtggtaagccgctgatcgaacagcgtcgcagcaaatccttacggtttttatccggttacaggcgcgggattagctaagctgcatgtactgtcacaacgggaaagcagaagatgatcgtaagcagcagggtgtatcgtccgggatgtgcgggcgaagaggtcgaagtcgatgatatcagtgaagtgatcaaagagccggaagcatttatctggctcgggctgtggcagccagacgctgagtttatggcgaagattaaagaggagttcggccttcatgaactggcggttgaggatgcactcaatgcccatcagcgacctaaaatcgaacattatggcgaatcgctgtttatcgtggtgaaaacggtgtgcgctaaggatgacagctgcgaaactgggcgaaacgcatctttttgtcggaaaaaacttcctaatcagcatccgtcacggcgcctctgaaagctacaccccggtgcggcagcgggcggctgaaaacccggcgctgctgaagtttggtcccgcttatccgctctactgcctgctcgattttattgttgatcgctatgccgagctctctacctcgctgaatgaacgggtcggacagatggagaacgatctcttcaccagtgaatttgatcgcaagtcggtgcagtcggtctacaccgtgcggcgtcatctgctgaaactacgcaatgcggcgctgcccgtggaggagatctgcaatcagctgatccacctgcatgaagatctgatcccgcgtccgctgcgcgcctacatccgcgacgtgcaggatcacgcccgccatgtcgtcaccgacgcggaagatatgcgcgaaatgctgaccagcgccatgcaggtcaatctggcgctggtgacggtgcagcagaatgaagtggtgaaaaagctggcgggctggggggcgatcctggtgatcccgaccgtggtcttcagtatgtatggcatgaacttcgagcatatgccggagctgaagtcgctgtatggctatcctttggcggtggggctgacgctgctggcctgcggcgggctgtgggccaaactgcgtcgctccggctggctgtaaacggcaggatgcggtgccagattgtcccgctgaaaaggtcacgacccgccagatagtgaaccgatactgtctggctatgcttaacgcagcgtgcagtttttgttcctgagccaacagtgtgtgaggtcacggtgaaaaaagaggatagcagcggtcaggcagtaccgattcaggaaaacctccgctgggtacgccgtgaatggctgattcagcgtatcggtgaatacgtcctgattgcgctggtgattctgggtgcgtgcggactcttttccaaaggcgtgctgagtaacggcagcgcccgctcgccggacgggaccatccaggtggagtatgaacggtttggccgggttgagagcaatatggatatgcgcattcgctacaacgcaccggtaaccgatcgctttaccgttacgattggcggtggcgccctggataacctgcaaatccagacgctgcagcctcaaccgctggaggcggtgacgattggcagcgatctgcggctgaacttttcggcccgcaacaccggaccggatcacgcgatctggcttggcctgcagccgcgcaatgcgggccgcattcacgtcactattcatggtgacggctatgctctggcccgttttacccaatggatttatccctgacagaggcgctttatggaaacggtattacgtgccgcagcgatctacctggtgctgatggtcgtgttcaaaattgccggcagacgcactctgttgcagatgacctctttcgatctgattctgctattgatcatcagtgaagcaactcagcaggcgctgctgggcgacgatttttctgttaccggcgctgcgctgactattatcacgctggtagcgattgatattgtgctgggcaaactgaaaagtcgctttccggtggtggagcaggtgatcgatggcggcccggtgatcctggtcgagaatggtaatctgctgactgaccgcatgaagatgaccggcatcagtcctgatgatgtgctggaagcggcgcgctccgggcagggtctggagcgatttgatcagattaaatatgcggtgctggaggttaacggccatatctcgattattccccgagccgataaagagtcctgaggggcgtttcgccctgacaggagagcgcccgtgccggagccgcgcaggttacacacgcctgagatatcctcatccccttgctgcagcaggccctggatgcattacagatcctcattgcgtcacgctgcgcttgttatgccgcttcccttgtaatcctgtcgatttcgttcagactgagtattccactcatgctttatcatcagagctggcctgactatcaatcagcgttatgcttttacagtcaggattaaatgaatgaatttacgcgatttaccttctacccggttaccggctggcaaattggtcccctgaatacccatcaggcactggtagtgaaattcggttatatcgatcccaatgccccgcgtgaaaagggcccgcaggagaccctgtttctgggtctgaccctcgaaatggcgaaaaagctggtcgccaatctttccgaacacatcgactacgctgaaaaaaagagcacccagcactagtttctcaccgcgatcggttaccacgcccaccgtcgggctattttgctgcgctgtcgcccggtgcataaacccgcagtgcactggctatcaggcgaaaatgtgcgggtgtctgaccgataatctcaccatctgcattgatgtaatggggacggcgcgtctcaatcgtcagctccgtggcgctgaatgcccgcacgttacgccagcgaccgtgagtgccgcgccgcagaaagggcagcagcgcaatgagctgccagctatgctgcagctccagactgtagacatccagtaacccatcgtccggagcggcacgctgttccactgtcatgccgcccccataaaagcgtccattgcccaccgacacctgaaccgttttgatcggcgtccgatggccctgatgcaccagcgtagcgctgaagggacggctctgccgcagcacccgcaaagccgccagggcataaccgcccactccccagcgttttttcgattccgccgtgaggttgcgcgccagttccaccgaaaagccgatgctggagacgttcagaaacaggtgctgattcacttcacccaggtccactgcgcgcagctgcccgtcagcgataatctttatcgctgactccaggctggcaggaatgcccagcgtgcgggcaaaatcgttggcggtccccagcggtaaaatgcccagcggcaggccggtctgcatcagtcccggcgcggccgcattaagcgtgccgtcgccaccgccgacgatcaccgcatcaacgcgatgggcatacgccgcgattaattcgctgtagctgcgggtatcatctccggccggttgcagcagggtgaacccggcctgagccagcagcgactgtgcgcggctggcctcggcgcgtcctttgcgcgagcgctgattaatcagcagcagggcagttttctgctgttgagacatacttttgcgttatcccgatgtcaaaatggctgtaacgagacggcaagtacagcactggcctgaccggtgaacaaccctgcttgcgctactttacgtaacctgttgagtgccataagcggcgataaagatcgtctacactgctaagggtcagatccacactgaggagttgcgatgacagaacacgaattcagaaaattgttagccgaacagggttttgacgagcctctgttgattgagcgtgcagccgccgcccagcttgataatcacgtacatccctttgaagcactggcactgattctgagtggtgacatcaccatcagtaccgaacaaggcgataccacctatcatcccggtgagacatttcatctgcagccaaatgaactccatcgtgaggcgtttcgggtcgcagggcgtacgctatctggcgggacgtaaatatgagtgactggcaatcagcatgaaggtttctgacgatctttttacccggctgtcacgctcgccgttccgtcagcgctttcgtctgggacgcgcggaatatgattatgcgagcagcaaaggcgagccggtattgcgccagcacgccgctgagtttgtggcacagcggctggcgcctgcgcagcctgaaaatgatggcaagcagacgccgatgcgcggccacccggtgtttatcgctcagcacgccaccgcaacctgctgtcgtggctgtctgagtaagtggcacaacatcggacagcaccagccgctgagcgcggagcagcagacctatatagtgacggtgttactgcagtggatcactcatcagatgcagcagcctgcaccgcctgctcgtgtcagccgaagccagccgaaaccggacgacgatccgcaactcgcactttggtaatggacgaaaaagctacagccggcggctttttctggtgaaaactggccctttttcattcctggtttattcttaaatctttcctgggaacactatgccaggattaaaacctacacggcaacgattcatacagagggaattatgaagaaatcaattattgcactgtctgctattttgctggcctcgccggtatttgctgctaccaccacagacaacaccgttgcggaagcgcataaaggcgccgataccgcgaaggaaaaactgcatcagacccagaacgaaggcaaagagctgaagctgaagtctgagcatgccgctgaaggcaaaagcgataccaccggcagtaaaattaccgaaggtacgcagaaaggctggcacaaaaccaaagaaggcactgagaaaggctgggataaaaccaagcagggtgctgaagatctgaaaaacaaagcgactaactaattcgcggctgttctcaggttaaaaaaaagaacccaccgaaaggtgggtttttttatggctgacgcggattacgctttcttttccgctgtttctttctccgatgcggctaacgccgcgactttcctttccgtctctgcagccgcatcggcggaggccgccgccgcttcagccgcagcctctgccgcggtatcggactgtttcttaccttcttcgataaactcttcgtcgatggcttcgatgttttcgcggttatcgcgtccggagagcaggttccagcaggcgataaacagagcggcaatcaccggaccgataacaaaaccgttgatgccgtaaatctccatgccgcccagcgttgcgatcagaatcagatagtcaggcattttggtgtctttgccgaccagcagcggacgcaggatgttatcaaccagtccgacaatcaccacgaagaagcccaccaggaacagccctttccacagtgcaccggtggcgaagaagaagatcgccgcaggcacccagataatggcggaaccgactgccggaataagggagaggaaggccatcagcgcgccccacagcaggctgccgtctataccggtaaaccagaatgccagcccaccgagaataccctgaacaataccgaccaccaccgtgcctttcaccgtcgcgcgcgccacggccgcaaacttcaccatcaggtgatgcttcacgtaggttgagagcggcagcgcttccaggatcagatgcaccagataggagccatctttcagcaggaagaacagcagataaagcatcacgccaaagccgacggtgaagctgaacgtccctttaccgatgataaaggcgctgcctgccacatactgaccgcccttaagggcaaacgaggagagcttctgctgaatctgttcggcgttatccaggttgttttcagccagataatgttttgcccagcgcggcagatgctgcaacagatcggcgaagaccgccgggaaactgcgccgaattggtctgcagtttgtgatagaccgcgttggtttcgaccaccagcgatgaggcgataatagccagcggcgtgaacacaatcagacagatacagagcagggtaatcaacgcggccaggccattgcgttcgcccattcggacccgcagatacgttttcagcggatggaaaatcaccgccagaatcgccgcccataaaatcggcgagaaatagggcgaaagcacctcgaaaaaaccgagtgtggcaatagccagaatcaaaatgaaaaacccgatgttcaatcctttaaaacgcatggaaaaacctcatctcgaacaactctgataaacccgacgcgcgaattttctgtgtctggctttgcttatgcggctgcctcgtcactgattatcggtcaggctttgctttttaaacgctgctgatgacagcatcatgctggctaactctttgaaaggtctggcagaagtgatgaacgggcaatgtgcgttcgctgcgtgacttcctataggtaacacgctgcaactgacagcagcgcgctgaatcctacattagcgtagcggtttcgaccattattggtaggtcagagactcatgatcccgggggatgctgccgataacagtattaactggataaaaaacaggcaatgaaaaatgagtaaacagagcgtcttaatcgtgctgctgacgctggtattaaccggctgcgccaccaagcagtatccgcaggcatccgcggtcaccccggaagagacggcgatgctgaattgcagcgcgctggatcaggagctggtgaaagcgcacagcgtgcagagtgatattgagcagaccggccagttcgatgcactgaccgtgctgggctttgtcggggatttcgggctgggcaatggcattgcgaaatacaatgccagccagaaggcggagcggcgactgacgcagttgcagtcgctgaaagccgcgaagtgcagccagcggctttcgtagcgactgcgccgggtcagccgagcgtccgtttcgctgacatgctgcagccggacattttcggcggcgcgtttaccggcaaggaaggcgtgatccgagttgtaatattcccactcgctgtagcggcctgacagatgaatgtcctgggtcagcagccactggcggatcagcgccacgttagcgctgcgcgcatggtcatagaccacgtaggcgtagggcatatcgacctctgaggcgcagagcagcggatcgtccgcggtgatcatgccaactctgatgcaatcctgacggcagcgctcaatcagcgcatcccccgccagcggcagcggattggccgcgttataggtgatttcgcaggttaagccgaaaccgcccggcgggttgcagtgcggactcgcattgccctgcacaaagatgcggtgaaacagcgtatcgccaggatagtaaatccagtgcttttcggtcaggtcggcgcggccaatccccagattaacgcagcgcaccgagacaaactgcaactgctgcaccgcccgttgcacactatccggcacttcatcgcccatcagtttaatcagctccggcagcggcatggtgctgatcaattgttcataacggtagtggcggccatccgccagcagcgcgacgtgcgcctgcgggtagaggcgggtcagggtggcgtccgtttccagcgtacatttcaggtgcggcaaaaagccggacatcagcgcctggaagccaccgcgcagcggatagccgaaacgggcgttggggccaaccggtttcgccagcggttgcagcgcgccatcaatgatctgcgccagatcgggcagcggtacgcgtccgcccagccatgaagtttccatgtcggtcagcggcaccttccacagtttctggttgtagggcagggcaaagtgacgcgcgatgcctttgccccaggtgcgcataatgaagtgctggaaatcctcttcgccttccaccacgcctgtgctgctgccctcatcggggatcgcgccatctgcgcagcagtcccgccgtgcccgcgcccgatccagtggcacagcggcggcggccgtttcgccataacgcgcctcgatagcgcccagcacgcactcttttaccacctcgaccggcaagccgtgtagcgcggactggaagggatagcgggtataaacgccgtcgctgtagacccaggcttcacgcgcctgccagtgcaggttgtcgcccagcaacatctcatacagctgcaagacgtacgggtcctgcgagaacataatgtgaccggcatagtcgaaggtaaaaccctgatcgtcaatcgagcggcaccagccgccaggcgtggcatttttctccagtaacactgcgccttcgccatagtgataaccggcgctcagcccggttggcccggctccgataatcaggcagggcacagcttcactctccagcatcaatggggttaacggcgtgatattcgcctgcgcgctgccctggctggccgaccttagtgcgggctgacgctgcgtcagcgcctgctggatcagtccatgaatctgttcagcggtgcgatcccatgaggtggcatcgacctttgcctgcatccgtcccgccagcgccagccgtttctgcggcaccaatcgccattgcctgttcacaggcggcaataaattcagcggggctctctgccaccgccacttcctctgcgtaatgccgcgctacgtcaataatcgcggtactgacaatcggcagctgcgccgccatatactccagcaccttggtcggtgagatgaagcgggtcgaggcattgatggcaaacggcatcagacagacatcccagcccgccagaaactgtggcagcgcctgatagggctgctgtccgagccagtgaatattgtcgcgctgcggcaggctggccggatcaatttttaccaccggcccgaccataatgatctgccactcggggtggctgtccgctagcgccgcaatcagcggcaggtctatgcgctcatccagcacgccgtaatagccaagacgctgtgccggaatcgcatcctgcatcggatgacgattgctgcgatcgcgcgcctgctcaaagtggatagcatcaacgctgctgggaaagcagtaaacctgaggatgtttgtcacgcttcgcttcatagaggctggtgccgccggtaaagaccagatcggcacgggtcatcagcgcggattcgcgctgctgcagctggcgcggggcattctgaaaagcggaaagctcatccatgcagtcgtaaatcaccagtgagggatcaaaaggtgtcagcaacggcagcgccatcggcgtatagaaccagatcagcggctgttcatcttcctccagcagcggcgtcagcagcagcagcagcggggcgatctggctgtcgtggaaaccaggcgcgtcgctgtcggtatgcggctggatcaccgtgatgttagcggcaggcgagctctgatgcaggccctgtggccccgcctgccagaccggctcttcgacaaacagcacgcgatagtgctgtgccagtcttgtcagtagctgctgcggacgctgaaaaacaaatccccagcgtaaatggctgaaaacaatgagaacaggtggtttcatagggtgctcctgacaggggtgttttaaggagtggatgtgctgcaaaaagcgctgcgcctgacgtaatgcgtcggcataaggctgctgtagctggcgggcatagggatcggcccccagcagatcgagatcccacaaaccgctgcgggtccagaaagtcgtctcctcccataagggacgatcgaggatcggatagaggcagatgccgtgcagctcaacgcctgccagttgcgcctgcgcaacctgcgcggcgatctcaaggatccagcttccgcgtccgctgccgacgtggctggtttccgccagcagcagtggccgctgataacgctgccagacctgctgcagcatccgatgcagcggcaggcgtcggctgtcgcccagatgccagtaaagccgccggtttgatccctgctcccactgattgtcgtggtagtaattcacgccaatcagatcgagatagcgtggggcgccgcccagttccgggttgcgcctgccgctcagcatgtcccatgcctgatactgggtgtcacacatctcacgtgccagcacgtcgctggccggatcggcgggatcgggcacgatatggatcagtggatcacagtgcagcagacgggctcgcggatcggccagccagatggcatcacaggctgccagcgtagcgcgcaccagctgctgcttggcggcatccgcccgatccgcttcagggatcgcctcacaggtgaacagccctaccgagataccccagctgacaaaggagatctcattcatcggagagtagaccggcgcctgctgataccagggggccaggaagcgggccagtgcgccacagaaggcggcgaaacggctgacaaagtcgtggtcaaacaggctgacgccagcgggccagccgtagtggcagattgtccagctcagctgaatgccctgctgctctgcggcctgcatccgggccgcgaccgtcgagaagtcatagcggccatcgtgctcacataaccgccagccgacgctttcgcgcactgtgcgaatggaaaagggggccagcgcggcataatcttctgctgcacgcgcctgatgctggttaagatcgttcatcgacagcgcaaggccggcaggattgatatgatcggcaccttcgtagccggcctgccagaaactggaaaagggcgtcatggcatctcccgaaaaaaagcaacacgcttcccgctgacgagccgtcgtgaaacgggtcagggcgtcagggtatgcattgcagactgatcgatctgaccactctgaacggacgggcgatccatgccataagccacagacactgagttgcaggcatcagggcctgtcgcggtgtggacgagtgagatagcaggtataggccagtgacgctatcggcagaaaaaggctggcttctctggatgttgaaaggatttgcggaagccttactggaaagtataggcagtaaggtttggttcgcaatttattgaagtaaaagaaaaaagcgcagcggtaaaaattatccagccagaaacaggaagttttagcatgcggttttgcgaacggcccgataagcgtagcgtgaatagtgtcagcgccattttcagctttgttaaccttttcctcaacatgcagagaggtcagactcgcccactttcgcgttacagcttcgcttgccttttggcgggctggcgacaagatttacttatcactggcctgaatcagcgggtcatcaacgggtgatgcgacgatgcgcgccccctaaaacaggatgttttacagactatgttctcattcgactggcaccgtttcttacttaacgatcaaccggccacctttttgtttgaggtggtggtacgggtcatgatcgcttatctggtggtgttcacctttctgaaagtctcaggacgacgcggcgtgcgccagctgtcgctgttcgaactggtggtgatcctgacgctgggttccgcgtccggtgatgtgacattttacgatgatgtgccggtgctgccggtcattatggtgtttgtagtcctgctggcgctctaccgcttcacgacctggctgacggcgcacagcccgcgcttttcacggcttattcagggcgacgtgattaccctgattaaagaaggattgtatgtgctggagagtctggatcgtctgaatatttctgaagatgagttttatatggagttacggcagagtggtgtagagcatctggggcagatccggctggcgctggtggaggttgatggtcagctcagcctctatttctacgatgacgatgagatgcgcgccgggttaagcgtactgcccccagagcaccggcaggattacagcactgtgccggtcagcgcgctctatgcctgcacccattgcggccagacgcagatcattgaggctgagcagcaggctgtctgcccgcgctgtcagcgacagcgctggtccgcggcactgaccgtgcgtcggctgcattaatcgccagcatccgctccgcgttcaggacttgtcgcgtttgcatcagccgggttaacgtcggcgaagcaggcgctgagcgggcgcttttgctgtcccccggcagcgaaattatccgcacttagccaggcactcagggcgcgctgaacatccggccattcacggtcaataattgatagccagtcggtatcgcgattacgctgtttacgcgtcatcacctgacgaaaacggccctcaaagcggaaccccagccgttctgctgcgcgtcgtgatgcgatattggttgaatcacagcgccacgccactcgccgatagccgagcgagaaagcctgttgcagcagcagataaatcgcctcgctgccgatgacactgcgctgcatcagcggcgaccaggtgacgtgaccgatttcaacagtgccgtgtcccggctcaatgctggcgaagcagaccacgccgcagggctgctgatttggcgagcagaccgtgaaggacaccagggccgcatccgccactttatccgcaatccagtgctgcatctgcggcagagaggcgggccgctctgcgctcagccaggtccagtcgcgatcatccggtgccagcataaatgcctgcaatagcggttctgcatgatcgatgcttagcggcaggagaaggcagtgctgacccgtgagtggcatacagggtggtctggtgaccggttgccagtcgggcagagcctcaccgaccggctgatcaaactgattgaggttcaatagcattctcctgaaagaaaacggacggttagccgggaaacttatgatgccgggctgacggactatcctgaaccgcggttaaacccgtcgcagcttgttcccgcttaccacataactttgcctgttactgacagaaaatgaaaacccttcgggcagcatagcggcaccgttaccaaagaggtgtgcgtatgaaagtgaggctggccagtgcattactgtttttgctgttatcgtttggcgcgttttcacaacaggtgatcagcgaaagtcatccccattcacgcagtgcgcgatggctggagcagggcagtcaggttgatacggcggattcgccggatgaacatctgctggagaggcgggagtggcgaagcagcctgcaacgcaagccgtttctgagatgagatccccggcggaaaacagccggggagccaggggttaagcgtttcagacccgttgtgaaattatattgtggcctgtgtcgctgccatgccaggcaccagaatcaccttgcggcactcctcttcgcgtttggcgaaaatatcgtagccacgcgcagcatcttccagcggcagatggtgggtcacaatctcttccggcgtcagatggccctgttcgatcagcttcagcaggtcgggcagataagcgtgtacgtgggtctgtcccatcttaaaggtcagccctttgtcaaaggcgtcaccaaacaggaagccgtgaatgaatccggcgtagacgcccggcacgctgacgataccgccacgccgcactgcggcaatacactgacgcaacgctttaccgctgctgccttccagtttgagattggtgagcacggtttcggtcatgctgccttttgcctcgaatcctactgcatcaatcactgcatccacaccgcgattgccggtgctgtgttcgataatccagccggccgggtcatcgatctcatcaaagttaatcgggataacaccgtagcgctcgcgggcaaagtttaagcggtagttgttgtggtcgatcatgtagatctgttcggcaccctgctgtcgggcgcaggcggcactgagcaggccaaccggtccggcaccgaaaatcgccaggctggagccgggtttcacctcggcgtttttcaccgcctgccacgcggtgggcagaatgtctgacaggaacagcactttctcatccgacagtaccgacggcactttaaacgggccggtattggctttcggcacccggacatattccgcctgtccaccgggcacaccgccatagagtttgctgaaaccaaacagggccgcgggcggcgtgatgtttttccggttcaggatggcaccacgtccgctgttggtattttcacaggcagcatactggctcatcaggcagaaaaaacagtcgccacaggcgataacaaacgggatcaccacccgatcgcctttggccacggcggtcactgcgctgcctgcttcaaccacttcgcccataaactcatgaccaaagatatctccgtgcccggtaccggggattttgccgcggtaaaggtgcaggtctgaaccgcaaatagcggtggcggtcacacgcagaataatgtcatctgcggcttccagacccggatcgggcacgttatcgacgctgactttatgggggccgtgataagttaatgctttcatctgttcatctcctgatgattaggggacggcggccaggccagaaggcgtggccacgcacgggaaagactcaggaaacctgaaatcgaaacctgtcagaagtgtagtaattctttaaggagtaagcagagcggtgcagccggctggtcagtttcagccgggctgacagggcggctgcacctgcgttgtggcggccgtcacgacttgggtgtcgggttgccagagagcgaggtcggcaaacgcacgacgataaaccgtgtcgatttgtgccggaacctgttcgatgtagtgccaggcatgctcacgcgtttcaccggtgagttgctgcagatagtgccgcgcgtcgtccagcgtcgggatctggccttcgacacccgccatgcgggcaggcagaccggtccagatcagaccttctatgcctttggtcttagcccattctgccagtggtcccgctgaggtcgccgtcaccgtcatcatcccgatgccatcgatacggctgtccggaatggcttcacggaggcgcaatgcgtggcaggcgctctcaagtgaggcggtattcagccaggcccagtataccggcaccgggctggcgttaagacagatcgcggtcgacagctcgccgccgtcagcgatgcgcacaaactcaatcggtagctcaggaccatcatgatgccactgactggccaccggcagtgcgccagctttccagattaacgatccccatccgaggcaggcaattttcattctcttctcctgtgcacctgtcggcgtgatcgcgacagaatctgttaaagcgtagcccgttgcgctgaaccgttacagggatcacctttttaggggcggtaaaaccgctgcaaagatggcatgatcgccgcgcagtcactttgcacaacctgacggttttttcagcaatccatgcgtgtttatctgcacggcttgaacttttatcgtcaggtagtgtaaaaattggcgcacgcaatcgattacctatgcacggacgggtcagcatcacgttgactgatccggttgcagctgaggcgcagagtggggcggacatttgcctgcctgacggctcaggttactggcggcttttaaaacggaagatctgatgaaaaccacgcaaactggcacgctgggcgcgcttgagagtgacgtcgatacgggatggcgcaaaaccgacaccatgtggatgctgggtttatacggcacggcgattggggcgggtgtgctgttcctacctatcaatgctggcgtcggcgggctgatcccgctgattatcatggcgatactggcgtttccgctgaccttttttgcacaccgtgccctgacccgattcgttctctccggtaaaaatccggccggggatatcaccgaggtggtcgaggagcattttggcgttggtgcgggcaagctgattacgctgctctatttcttcgctatctatccgattctgctgatgtacagcgtagcgatcaccaacacggttgagagcctgatggtgaatcagctcggcctggtgccgccaccgcgtgtgctgctgtcgctgctgctgattgtcggactgatgaccattgtacgtttcggcgagaagatgattgtcaaagcgatgagcgtgctggtttatccctttgtggcggtgctgatgctgatggcctgctatctgatcccgcactggcacggcgctgtgctttcgaccctgaacgttcagcccgcgggcagcagcctgtggatgacgctgtggctggcgattccggtgatggtcttctcctttaatcactcgccgatcatctcctcattcgcgctggcaaagcgggaagagtatggcgatgccgcagagaaaaagtgttcgcgcattctggcctgttcgcacctgatgatggtggtgacggtgatgttctttgtcttcagctgcgtgctgagcctgtcgcctgaagatttacacgccgccaaggcccagaacatcaccattctttcctatctggcgaaccattttaaggtgccgatgatcgcctggctgggaccgctgattgccattgtggcgatcacgaaatcgtttctcggtcactatcttggtgcgcgcgaaggatttaacggcatggttaataaggcgctgcgcagtcgcggcaaaaccatcgcgcccgccagactgaatcgcctgaccggactctttatgctgctgacgacctggctggtggcaacgctggaccccaatattctcggcatgattgagacgcttggcgggccggtcattgcgatgattctgttcctgatgccgatgtacgctatccagaagatccccgcgatgcggaagtacagcggtcacatcagcaacctgtttgtggtgctgatcggactgattgccatctccgcaatcttctattcgctggtgaagtaacacttagcgcaacaggcgcatctcaatccccctgggatgcgcctgccattctgcccgcccttcgccattctctccgttcacctctacgcattcagcgatctcgccccgtgatttgagcccggtgccgcgttgttaatgccgcctctcagacgcatctggttagcaatagttacatttggtacttatcagcatggtagagttaacgcgaataattattattccctaaaaggacaggagaaaaatgaaaatcgggatagttgctgccaccacacttttactgtcaaccacctgtgcggctaccacctatccggtcacggtgaccgatatggatggtcagaaaattacgctgcaaaaagagccgcagcatgtgattttacaggatgggcgtgacgtgatggcgctggcattactggatcgccagaacccgtttcagcgtgtcgttgcctggaacaacctgccgaaaaagcaggatacccagacctgggacctgctgaagcagcgctggccgcaggcggcatcgattgttgatatgggctttaacgatcaggggcaggtcaatctggagagcgtgctggcgaagcagcccgatctgatgattgcgcagctgcgcgccaaaccggccctgacgcagtcaggcgtgctcgccaccctgaaaaatctccatatcccggtgctgttccttgatgttgaacttcatccgaaagagaacaccctgaagagcgtgaaagtgctgggcaccgtttctgaatcgcgaagccgaggcgaaagcttacgccgatttttaccagcagcgctggcagatgcttcagcagaagattgcgcaggtgccgcacaagccaaccgtgtttattgaaccgattgccggtaacagcgacaactgctgctttacacacggtcataacggctggggcgcgctggtggaagcggtcggtggcaagaatatcggttctgcactgctgcccggcagctcaggatttgtgtcgctggagaagattatcgccatgaagccggacgtctatatcatgaccggctctaaacgcccgaacagtaacgtgctgccgtttggttacggtgccagtcagaccgacgtgaccgccacctttaaccgcctgcagagccgcaccggtctggagcagatcgaaccggtgaaacagaaacgggtgtatggcgtttatcaccatttctataatcacccttacaacattatcggcatggaaattctggcaaaagatctctatccggaagtgttccgcgatctggacccgacggctgattaccaccacatcgtgacgcactttaccgggttaccggatgcgccagtgatcctcagcacgccataaccgcaaaaatgtcagggtgcgtttcagcatcctgacttttcatcggccatcatccgtcaaccagagcgtgattttcagacagcgcaggttgcccggttaacctctggattgcgtcagcaacgttgtcatcgcatgtcctgtgttaagaaagcgctaagcaagcgtaatagtgtgtaagttaccggattttaagacttttacagatgtctcccgccacaattattgccatgatgccgatcaacggtgcctgaacagccgttattttcggaggcagtatcatgaaaaaaacaacattaacgcttatcgcttcacttttgacatgcagcacactcttttctcaggcctcacgggcagacgatcgtgatgacgcgcaccgcaagcctgtgccgcatcagaaacggtgaccatcgtgctgacaatcgcggttctgaccagaatcaggagcgtggcaacaaccgtcatgacagcgtcaatcatcgcccggatcaggacaacaacggtcggggcagagaggcacgtaatgaccgcgaccatttcgcctggcagggacacgacttccgtcgcgggcatcctgtcccgcaagagtaccgcggcgaccattaccgcgtagccgactggcatgaacgcggtctgcgtgaaccgccgcgcggttatcactgggcaaacatcgacggcaactatgtgttgattgctgctgcaaccggggtaattaccgcgctggtgctgaacagcgccctgaactgatccccaggggatggctgcggccatcccactttctttccgttttgccgcgccagcggctatcctgacactccacgctgaaaattccctgtgtaaggagtcatgatgacgacggttaagatggttgcggtagatatggatggcacctttctggacgataacaagcagtacaatcgatcccgctttctcgactgctatcagcaactcaccgcccgtgacatcaaatttgtggtggccagcggcaatcagtattaccagctcaaatccttcttcccggagatcgccagcgatatcgcctttgtagccgaaaacggcgcatggattatcgatcgtgatgaggaactgttttgcggtgcctttgaacgccgcgatgttgacgcggtgatcgataccctgcaaaacggcgactatccgggtctgcgttacctgctgtgtggccgggagagcgcctggtacttcgacggcatggaagagaactggctgaagaagatgcgccattactgtcaccggctgaagccgattcatcatctggatgaggtgcagcatgaccggctgtttaagttcgcgctgaatctctctgatgactatatcgagccactgatggcggatattgaacgtctgcatcaggggcgagtggcagcgacctcaagcggtcacggctcggtggatttgatcgtgccggggaatcataaagcgcacggtctggatctgctggcacaacgctgggggatcgcgcacgaccaggtgctggcctttggtgatggcggtaacgatctggagatgctcagacagtctggcttcagttttgccatggacaacgcgccacagcgggtgaaacaggcggcacgctatgccgcgccttctaacaacgagcagggcgtgctgcaggtgattgagcagatgctggcaggtgaggggccttttagcgccacgcaggcttagccgtctggcgctgcgattaagccagggcggttagcgccgtgattcagccagccgcctggctcagagagcgggtgcaacaggatagcgctgaggagcagcaaagccgggcgaggctggcaggcccggttgtgcctggtcagcgaatgcgggcaacgcggctcctgatcacgccgtgatttcccaggcctgcgcgatcatcatctgcatctgttcgcggctgtaattcaccagcgaatttttgctgttggctcgcgccagaatccactccacctcggcgcggctcagtgaagggccatcctgccagaatggggtgatcgcctgctgctgcagccactgtttcagaaactgcgccggtgagtccgtggtttcgctgaagagctgcgggtgcagttccgccattagcttacgctgcagcggctgttcgctgtcggacaacagatccaggaacggaaacagcagacgtccgcacacttcaccgtgatggaacggctttatcgcgcccagtttcccccgcaataccgtggatcacccccagacccgcactgctgagactgacaccgcccagccacgacgccatcatcatcgcttcccgtgcctcgtcgccagcagcatcctcacgattaagtgcaggccaggcctgaacaaactgacgcaggccggtcagcgccagctgtcgggtaaagaggttgcctttgccggagagatacgcttcaaacaggtgggtaaacgcatcaataccgcaggttgccagcacccggtccggcgcacctttcagcagatcggcatcgagaatcgccacctccggcacaaagaccgggtgacgcagtgatgcttttatctgaatgtcacgctggtcagtcaccaccgcattttgcgtcacttcactgccggtgccggcagtggtcggaatagcaatcagcggcaatgtgatgggctgaaccgcggtgtcacccactttttccagatagcgggcggttggcaatgggtgttgtaccatcgcactaaacgctttcgccgcatccagcacgctcccgccgccaatcgcgacgacccgatcgacatgaccgcgccagcgcgcaacccagccatcaatctcggcgggtgaggcttcatgactgacaatttcatagccaataatatgatcgttgagtccggcttttagccgggcatatgcggggccttgcagaaaagattgtccacaaaacagcagagtaggctgtgaccgggcggccagcagcggcaccagtttatccaggctgccccggccaaagagggttcgttgattactgtacagctcactcaggttcttactcaccagcgcatcctttttacatttcgctaaaatctgagtgtaacgaaaagcaaggcgccgggactggcaaactttctgataacgcattggcaaaaagttgatcaccttcgcaaaacagaaattcacccccggcggggtggtgctttcctgctgatgttacccttaacatgttatcggtaacagcgtttgtcgggatgtgtaaacatcttacagcgcactgttttgtagccctcaggggatcatgataataaaccgacactgaatgatgttcagtgcacaaggtggagaaaagctatgccattactctatgtggcgattggcgtcgcgttactgctgctgctgatgattcgctttaagcttaatggatttatcgcgctgatcctggtggcgctggcggtcggtgtgatgcagggcatgccggttaataaagtgattacctcaatcaaagcgggcgtgggtggcacactgggcagcctggcgctgatcatgggctttggtgccatgctcggtaaattgctggccgactgcggcggtgcgcagcgtattgccaccaccctgattgaaaaattcggcactaagcatattcagtgggcgctggtgctgaccggttttatcgtcggatttgcgctgttctatgaagtcggctttgtactgatgctgccgctggtgttcagcgtggcggcgtcggcacgtgtgccgctgctctatgtcggggtgccgatggcggctgccctgtcagtgacgcacggctttcttccgccgcatcctggcccgaccgcaatcgcgacgctgtttaacgctgacatgggtaaaacgctgctgtttggtacgctgctgggtattcctacggtgattctggcgggtccggtctacgcccgcttcctgaaaggcatcgacaaaccgattcctgagggtctctataacccgaaaacctttaccgaggcggaaatgcctgggtttggcgtcagcgtctggacggcactggtacctgtggtgctgatggcgctgcgtgcggtggcagagatgctgctgcctaaaggccatgtgctgctgccctatgcggagttctttggcgacccggtgatggcgacactgattgcggtgctgattgcaatcttcacctttggactgaatcgcggtcgcacgatggaacaggtcatggataccctgaccgactcgatcaaaatcatcgccatgatgttgttgatcatcggcggtggcggtgccttcaaacaggtgctggtggacagcggcgtggataaatacattgccagcatgatgcattctactcagctgtcgccaatctttatggcctggtcgattgccgcggtgctgcgtattgctctgggttttctgccacggtagcggccattaccgccgggggaattgtggcaccgctgattgttaccagcggcgccagcccggaactgatggtcatcgccgtagggtccggcagcgtgatcttctcgcacgttaatgacccgggcttctggctgttcaaagagtatttcaacctgacgattggcgaaaccatccgctcctggtcggcgctggaaaccattatttcggtctgtggtctggtgggttgcctgctgctctcctgggcgatttaacctctggccgctggcaagcctgccagcggctctctgctttcgcgtctctcccgctgcctctttgagctttgaacatcccgtcgcgcttggtgcccctgttgccggttaaaccgggatgtgcgggacagacagcataaaaaaggccgcaaggtgcggcctgacagagaagattcagtctgaatctgccacgttaatgaggctgttcaaaaccggctttcaccatctgttcccgcagcgcatgtgcaatgtcacggttgccaccggtaacggggtagataacgttattcaccacatcatcaaggtagtgctcgtcaaactcctgcagagagagctgcgtgccgccttcatcgttgatggcgaaagtccctttgatgtggttaccgctgttttttgccttgaggctgtagcggcccatgctggtattaatcgtgctcataagatctcctcgcgactcattttcaatctcatcactcttgaggcctgccttgccgcctaaattttagccaggagtgttctgtaaaacgaagaaagagagccgttaaaaagtggtgttgcgatcgttatctcagaatttaaataaagctcagggttgatgaacttatgaccagttgagccttaagtgaagcggcagggcgcattttcctgtctataatgcttacaggaaaagtgtttaattggtgaggggaaaggaaatgaaaattattctgtggattattgcgatcatttttatcgttggcttactgaccctgacaggggtgttcaaactgattttctgatatctgttaacgcttcagcaacagcgggcacctaatcaggtgcccgcaatgttttctggctggccaacagagcgtctgtaatgggatccatcggcgtattgggcagcagatcctgtgagcccagaggtttcttacagtatgcgcagcaggcaccatgaaagtttcgctggccctcgcggtaatcagtaaaaacgaatcgggcgcttccacattgaccgcaacgtatcttcatcaccatcctgtgtctcaccctccttttactcagcattaacggatgcttgtgcctgacaggttaagcggactttatctattgcgcggcaatattatttcgcactgcgataagaaaagtagtttcttatgcttttgattgtttgttgccaaatgcgcattcggccactaaaaagcatttcattgatccagatcagtgtttattagttgttggctaaaatatccgcgaatagcctgccatgactgatgataatggcacagccgactcattttttttggcgagggagcgggatctgcgccagtgaatttaagatttatcgtacaataaatagccactggcaggacgcaggcctgaaaaagcagaaaaacgggtttaaggtcatgggacttaccgtccggatgatagaaaaaaattgaccttttaccggcgtaaacgtcattaagaacaggaatatatcttaatcagatttttctttttaacgtcagtaacgtaaccgcttaaaattaaaaagggtttcgtttccagcaggttagcgaccgatacccgctctgcgcctgatacgcgttgagcgatgtttcgcaagtcgaaaagcaggaaagtgtgatggatgtacagaatgtcgatatttatcactttttcatcaaatcatgctggacaaatccctcagcaattgctgtactagaccccgacacagtttagtgtccatttttcatgtaaaggtaatatagatgtctaagatcaaaggtaacgttaagtggtttaatgaatctaaaggattcggtttcattactcctgaagatggcagcaaagatgtattcgtacatttctctgcaatccagagcaacggcttcaaaactctggctgaaggtcagcgcgtagagtttgaaatcaccgacggcgctaaaggcccatctgctgctaacgttatcagtctgtaagttaacagtcagaattctaaaaacccgccttatggcgggtttttttatggctgtaatctgcgcttcatcccgcctgtcgtactctcactctcggcgtgttgccgcacaaactgcgcggcggttcacactaaataaccgtaacatatttataacaacccgatatgcagctttttggcttgcgacgctatataactgtgcgacagaaacccggtgagtgaggaggcaggatgaacatacgtcaggcagagttgaaagacagttttgcgttgagtgcattactgagcgagttaggctacggcggcactgaaagctttattgaacagcgcctggcgcagttatgcagcgatcccagtgaagcgctgttggtggctgaacatggcagtcaggtgctggggtttctctccttacattttattcctcagctggcgctggccggtgatttcgcccgcatcagctatttctgcattgcagaaggtgagcgcagtaaaggcgtcggccagcagctgattcagcatgcagaaatgctggcggctcgtcgtggctgcgatcgcatggaagtccattgccatcagtcacgtctcaaggcgaatcagttctacacccgtgaaggctatgttgaatccccctgttatctcatcaaagatctgcaagcgagttaaattcccgtccgctggcgatgaccagcgccccggcaatcatctcccgctgttcatccctgaggctggcgatactgacgcgaataaattgggttgggccgagccgacagcgctcgcctggcacgaccgcaataccgcgggcagccagcgtgatcatggcaaactgctctgaagtcaccggaatatagaggcttaatccgtcgcgaagcggcagatcaagcccacgctgtgccagcgccgtgagcaacgcttcacgccgttgccggtaggtcgcgcgtgcggtggcgatctgccgttgcgtttcctcatcctccagcagccacgccactgcatcctgcagaatgcggctggtccagctgacgccaaaatttcgccatgactgaatgcgcctgaccatctccgaggtggcagagagcactgccagccgcaggtctggtccataggctttggaaaacgaacggacgtgcagcgtgcgctcaggaaagattgaacccaggctccagctcgcctccgcggagagatcgccaataccatcatcctcaacgatcagtgtgttgctctgttgcagaaacctgcgccattgcctgacgtcgcgccgggctgatgctgttcccggtggccgagtgggtgcggggctgatagatcaacattaccggtgcctgctccagcagaagagaaagaacctctggcagcgggccttgatcatcacacgccagcggcagaatctctgcgccgacgttatccagtatatcgagcagccgggtcgcggtcggatcttcaataatcacgcggtctcccggcgagaccagggtttgcaccagcagattcatcgcgtcaaaaccgccatctgtcgccagaaacgcctctgcagcatagggccagcgcggcgcgatcgcctgaagcagcggcgcggaaatcgcctcacgggtgtagctgttgagctgcggtgagtgcagggccgcctgcagcgcacgctgcaggtcaggcagcagggcggggtcgggcgcggcgagggtcagatcggcgcggatgttatcaccgtagttgccgatcttctcaaagcgaatcggacgcggcatcaccgtattactactgacccagacaccactgcggcccttgcccgccagcactttctgctttcttagttgcgcccaggcagcagaaacggttgccgggctgacacccagctgctccgctatctcccgcaccgcaggcatctgcatacctgtcgcgatctgtccgtcacgaatcagcgcggaggctgcctgtgcaatgcctttcactgaaggcgattttatctggctgcaaaaccagttgaggtcgacgctctctgtcataagaaaatactttgttcagtaacaaattaatgattgttcaggtaagtattccggatctagtatcaaattcaagcactattttatgccccgtcccgacggtgcagcgtaaacggagagatcatggcaaggctactcatcagactggcggtacgcgactgggactacttcaccccgctggcgctgggcgatatcagaccagaaggttttgaactgcagatcgaccgcgtcggcacacttgtgaatgatctggcgaccagccccgactatgacgcgggcgaggtctccttcagccgctatgctcagggccgggccagaggagacgaaacactgcttggcctgccacacttcctgatgcgcggcttccgccagcgctgcattatcaccaccagcagcagccccatcaccacgcctgcgcagctgaaaggtaagagaatcggcgtcaccggctggcaggattcgggcaatacctggacacgcacggtgctgcgtgaagcaggcgtcgaaatcgatgatgtgttctggtatgccggtcgtcttactgccgatcatccgattgtcgatcggctggcgggatttggccgcccgggccgcattgaacccgcgcctgacgagcgaccgctgatagagatgctgcaggcgggtgagctggatgccatcttcacgccatttatgccggagggctttttcctgccgggttcgggattacggcagctgcagaccgatttttatcaggcggagcgggactactttaatcgtgtcggctatgtgccgggcatccacattctggcgctgaaaccggcactggcggcggagcatccgtggctgcctgcggcgttaagtgaggtcatcgatcgctcttaccggctgtggatgcagaaaagagagaaatatgccgacaccacgccgtggctgctggacgatttgcgacgcactgcgcaggaattgcccgctgactggaatcagaatggttttagcgttaacagaaagatgattgcggactttggtcgcgagctctatgagcaagggctgactcaccaggtactgacgccggaagcaatgtttccggccgctgcgggagaagagaaatgatgaaagtagcactgggacaatttgcggtgagccgcgaatggcaggagaaacgcccgtatctgtctggacttaatgcagcgggcgacagaaggtggcgccgatctgctggtactgccggaaggggtgctggcacgtgatatagccgaccccgatttagtgctgaaggcggcgcagccgctggatggcccttttctgagccagctgctggccgccagcaagcagaatgcactgaccaccatgatgagcattcacgttcccaccggcgagcaaaaagcgctcaacgtgctggtagcgatccgcaacggtgagatcatcgccgcctatgaaaagctgcatctgtacgatgcctttgcgatgcaggagtcgcagcgggtcaatcccggccacgtcattccgccgctgattgaggtcgcgggtatgaaagtcggattaatgacctgctatgacgtgcgcttcccggagctggcgcgtcggctggtactggatggtgcagaggtgctggtgctgcctgccgcctgggttaaaggtccgctgaaagagatgcactgggaactgctgacccgcgcccgcgcgctggaaaacacctgctatatggtggcggtgggggagtgcggcccgcgcaatatcggcaacagcctggtggtcgatccgctgggcgtagcggtggcgaatgcggcggaatcgccggcgctgctgtttgccgatctcgatcctgagcgcgtcgcctatgcccgccgggtgctgccggtactggaaaaccggcgctttgcccgtcccgaactcaactgatccgctgaaccaggaatccattatgacgaagagagcaaccgccttaatcgtggcgctggggctgactgcatccctggcgcaggctgccgacgctattccggtgcaaaaagttgaccaggccctgcatgacaggctgccagatgagatcaaaaaatcgggcaaaatgatttcagtgaataacggttcatttccgccctatgaaattgtgaatggcccgcactcaatggagggcgcgtcggcggagttaacgactgcgctggcacaactgctgggtgtgaagatcgagcatgcgacggtgagtggtttatcaggcgtactcaccggcatcaatgcgggtcgttatcagctggcaattgggccgattggtgattatccggaccgtcagcagaaagtggatttcatcgattttgtgcaggagttcgtggtgttcggcgtgcagaagggcaatccggccagaatcaatcagctggacgacacctgcggcaagcgcattgctgtcatggccgctggctctgcggaacaggttatccgtaagcagtcagcctggtgtgtggccgacgggaaaccggccgtgacggtgcaggcctttaccgatcagccttcatcaattctggcggtacgctctaaacgctccgatgcgttcttctcatcacaggcgccgctgacttactttgttaatcaggcgaaagggcaacttgagctggcgggcaaagggcagaaaaacggctttggcgatattttccagggcacggtggtgccgaaaggctcgccgctgggtcaggtggtgctggatgcctacaaagagctgtatcagaacggaacgtatgcggccatcatgaaaaagtggcagcttgagggcaacatgaccaccgcacccggactgaatctggcgaaagaggccagcaaatgagcccgccgcgccatctgcacagcggcgaggcacagctgcgcgacgtggcgtttcgctcgcagcgcccccacttacggacgctggatcagctggattttagtgctggtgatcggcaccaacctattgtggctggcggcgaccaaccctaattttgaatggcaggtggtactcaagtggtttaccgaaggatccgtgctcaaagggttgcaggtcactctggggctgacagtggtgtcgatggtgctcggcacgctgctcggtctgctgctgggtgtctggcggctctctgagaaccggttgctgcgcggcgttgccggactctatatctggttctttcgtggcacgccgctgctggtacagctgatcttctggtacaacctttctacgctgtttccggcgctgtcgctgacgctgccgtggaccgatatcacgctggccagctggaacaccaacgatcttatcaccccgctgacagctgctattgccgggctggcgctgaatgaagcggcctatatggcggaaattattcgcgccggtctgctgtcggtggataacggtcaggtagagactacccaggcctttggcatgagtcgttcacgggcgctgcggcgcatcatcattcctcaggcgatgcgatcgattattccacccaccggcaaccagctgatcagcatgatcaaggcgacgtcgctggtcagcgtgatcgcaatgggcgatctgctctactcggtgcaggcgatctacaaccgtaccttcgagatcatcccgatgctgatggtggcggtgatctggtatctgctgatcacctcgatcctcaatctgggccagtccgccatcgagcgttactacgcgcgtggcactcgtcgggtggccagcgcccccagacgcgccaccatcgcggctaacgtgcaaccccagcaggaggagcaatgagtcagcgtgaacccctggtctgcgcccgcaacgtgcagaaaaattacggcgacaatcaggttctgaaagggatcgatctggatgtctggcccggtgaggtagtggtgatcctcgggccatccggttccggtaaatccacgtttctgcgctgcatcaatcatcttgaagagatgaacgccggatcgattcgggtcggtgatgagcagatcgggtatgtacttaaagggcatgtgctgcaccggttgtcgccacgccagatcgcccgtcagcgccagaaaattggcatggtgtttcagcagttcaatctctacccccatatgaccgtgctgcagaacatcactgaagcgcccatcggcgtgcataaattcccgcgtcaggaggcgatggcccatgcccgatcgctgctggcgacggtaggattaagcgataaagcggacgcctggccacgtcacctctcgggcggacagcaacagcgtgtggcgattgcgcgggcgctggcgattaagccgcagctgatgctgtttgatgagccgacctccgcgctcgatccggaactggtgggcgaagtgctggcgaccatgcgtaccctggccgaccagggattaacgatgatcgtggtgactcatgagattagctttgcgcgggaagccgccgatcgcgtggtctttatggatgggggtgtggtggtggagcagggcacgcctgaagaggtgatcgcgaatccacagcatccgcgcacccaggcgttcctgagtcgcttcatctgagatcttactctgttacagattccagttgtcgccgcaggcaaactgcgcgtaaatatcagtcaccgtgattcgataaagttgaaaggttaaatatggaaggtatcagtattgccaagctgctgattatcggtgcgcttatcgtactgctttttggtaccaacaagttgcgctcactgggtggcgatctgggctccgcaatcaagggctttaaaaaagccatgaaagatgaagataccagcgcaacccgaactgcggctgaagacgtgccggcagaaacgcgtcgttcataaagattaatcggttatttgctgcaaataactgttactttttatttcaggcacagataaaaaaaccagactgtttccagtctggttttttgtttttcaggcttcctgaagcaaaagcgtgcttatttcacttcttcgcctttggcctgcatatccgcatgataggaagagcggacaaacggaccgcacgcggcatgggtaaagcccatcgccatcgcttcttctttcatctcatcgaactcagccgggctgacgtagcgctgaaccggcaggtggtggcggctcggctgcagatactggcccagcgtcagcatagtgacaccatggcgacgcagatcgcgcatcacttcaacgatttcggcattggtttcgcccaggcccaccatcagacccgattttgtcgggatgtgaggatgcgcctctttgaaacgttcaagcagcttcagtgaccactcgtagttcgcgcccggacgcacctggcggtagacgcgcggtacgttttccagattgtggttaaacacatccggtggcgtcgcggtgagaatctccagcgcgcgatccatacggccacggaagtccggcaccagcgtttcgattttgatcgtcggatttttttcgcgaatcgcgctgatgcagtcggcaaagtgctgtgcgccaccatcacgcaaatcatcgcggtcaaccgaggtgatcaccacgtagcgcaggcccatatcggcaatcgtctgcgccagtttagcgggttcgttagcgtcaggggcattggggcggccatgtgccacatcgcagaacggacaacgacgggtacagattgcgccaaggatcataaaggtggcggtgccgtggttgaagcattcggcgaggttagggcaggatgcctcttcacagactgagtgcagcccgtttttgcgcatcgcggccttaatgccctgaatacgactggagtcagctggcagcttgattttcatccattccggcttacgcaacatctcctgccgttcaacagccacggttttcaccgggatcagcgccattttgtctgcgtcacgatatttgacgccgcgttccatctgaattggtttactcataaatcagcaggttccggtcggattgcgatttgaaagcgttcccactcaaaccgggaaggctgctttcaactttatttgaaaaaagtgcaaaaattatatcatcacatcgcctgcgaagcagccacagtcagcgcggataagttacatatttgtaaattcgcattctgcgttaaggtttaacaggcagatcccctgaaatccattcaacattttcataacctgacagccgtgcaaacgcgttgaccagcggagagtgtacctgctccgtcgtcacctctggctggaaatttttcaactgggtcatgctcatgccggcgtaaccacagggattgatgcgcaggaaaggcgacaaatccatagcaacattcagcgccagaccgtgaaacgagcagcctttacggatgcgtaatcccagtgagcagatcttctcttccccgacgtagacgccaggtgcatcagcacgggcgcgggcgctgacgccaaactctgccagggtggcgataaccgtctcttccagaatggtcaccagctggcgtacgccgagcttacggcgttttacatcgatcaggacgtacatcacctgctgtcctggcccgtgataggtgacctgacccccacggtcactctgcaccaccgggatctcgcctggcatcagcagatgctctgctttgcccgcctgaccctgagtaaagaccggaggatgttcaaccagccagatttcatcacgactctggtcgctgcgctggtcggtatagtgatgcatggcgtcggagacagattgccagtcgcgcagacctgactggcggacaagaagagtttcaactgacaaaacgaaagcccgctaaaggaaaaaacgctgaggataacgtcggcaaaccgtcaggcagaggcgccttgccgacccgtaaattacagtaccatccgcacaatttcgatgttgcccagctcttcgtacaggcgttctacctgctcgatgtgggtggcggtgatagtgatgttgacggagtgatagttgcctttgctgctcggcttaacttcagggctgtagtcgcctggcgcatggcgttgcaccacttcaaccacttgatcaaccagctccggttgtgccagacccattactttgtaggtaaacggggtaggaaattcgagcagctcattcagtttggttttcatattaactccggtgcataaaaaacaggctcccgcctgagcgggagcaacataatatcgtgtaatgggggcgaaggggtgatttttcaatcacccgccacgcttaaccgaaccagtgatggaacatcagcttgatgtaatcaacgatacggccaaagaaacctccttcagagatctcgttaagcaccaccagcggacgctgttcgatagtcttgccatccagctggaagttgatgctgccgaccacctgatttttcttcagtggtgcatgcagttccgtgttggtcagcacatagctggctttcagatctttcatgcggccacgtgggatggtcaggtaagcatctttttccacgcccaactgcacacggtcgttatcgccgaaccagactggctcagaggcgaactctttgcccgctttcagtggcgccacggtttcaaagaaacggaagccccaggtgagcagtttcttactctcagtttcacggcctttgtaggtatgaccgcccattaccgcggagatcaggcgcatctggccttcagtcgcagacgccaccaggttgtaaccggcagagttagtgtgaccggttttgatgccgtccacattcaggttggtatcccacagcagaccgttacggttcatctgacggatattattgaaggtgaactctttctctttataaacagcatactcttccggcacgtcacggatcagcgcctgaccgatcaacgccatatcgcgcgcggagctatactgaccttccgcgtccagaccatgaacggtctggaagtgggtattctgcaggccaatcgctttgacgtagttgttcatcagattaacgaacgcatcctggctgccagcgacatagtcagccatcgcaacacaggcgtcgttaccggactgcagtacaatcccacgggtcagctgagagaccggcacgcggtcgcctggcttcaggaacatcagcgaggagcctttgaacaccgggttgccggtcgcccaggcatccgggccgacggtgaccatatcgtcctgatgaattttacccgctttaacggcctgaccaatgacatagctggtcatcatcttggtcagactggcaggatcgcggcgtgcatcggcatttttctctgccagcactttgcctgagttgtagtcgataaggacgtacgcttcggcatcaatgtccggcacgcccggaatcatggtcttgagattgacgtcatcagcaatagcagcatggctgagagagaaagcgatcagtgatcccactgtcaggcgtttcagcaaacgagatgatttcagcgtgttcatgtgtaggactacaacatccgtgagtttgaggttgaaaatgtcactcatcatacccaatgccagattaactggcaccgggcgtgatgattgggttgttagcagacgtaacgtgcagctgtctgataaacggttcagcgacgcgtgttagtaataaatgaggcggcctggccttcactgctcagacgctgttgcagcgcagccgcttcggcgcgggaggcgtaaccgccgagctgaacgcgatacacattgttgcccgcgtcttctaccttaccgggcacgccataacgctggctcaggcttttcatcatctgctgggcacgcgccgggtcattcagcgcaccgacctgcactacatatccatcggcaccaccactgctggctgcaggcgcggcgctggctgctgcgggagcagcattgctgactgccggtgcggaactggcgggtgcggcggctggcggttcattaccttccagtacgccggttgctaatggctggggtgcaccaagaaagccgctgctctgcaccggcgcgcccatgttgtcaccgctttgcagcgtactgttgctgatggcctcaacattttgcgcaggcggctctgagggggctgcgctgccgccgttcatcaccgcgccaccactcaggtccggacgggcaggcagagagtagctctgttttgccacgacggtcccgatggtgccggggccagagagcgagccgtctggggcgaccttgatgtaatcaacccgcacgcgcgaattgttggagatattcaggcggtcaccggcagcccgcgacaggtcgataatgcgtcctggcgtgtaagggccgcgatcgttaacgcgcaccacaatctgacggccattcgcgatattggtcacgcgcacatagctcggcagcggcagagtagggtgggccgcggtcagcgcatcaggatcgtaggcttcgccggtagcggtgcggttgccctgcgcctcttcgccgtaccaggtggccaggccgacttcactgtagttcgacggatctttgatgacgcgataatttttgccgttcacgctgtaatcctggctggtgcctggattgatcggctcataacgtggctcaacgcctggaatctccaccaccggtccattgtaagccggttgcggcggcgccgtattttggggtttccggcgtggtacaggccgccagaaccagtgatgccagtgcaacgccaagccattccttacgcatctgcagcctcttagacacttttagataacatttttcggtgagtgtggatcgacatcacaatgccgaatcccgccataagcacgataagcgcggagccgccataactgaccaaaggcagcggcacgccaactaccggtaagataccactaaccatgccaatgttaacgaaaacataaacgaataaaatcagcattaaaccgcccgccattacccggccaaaggtggtctgcgcccgggctgccaccaccaatccccgcatgatcagcagcagataaagggccagcagcagcagcacgccaaccaggcctaactcttcggccagaaccgcaaagataaagtcggtatgacgttccggcaaaaactccagctgagactgggtgccctgcagccagcctttaccgcgcaggcctcctgagccaatagcaattttcgactggataatgtgataacccgctcccagcggatctgtttccgggtcgagcagcatcatcacgcggtcacgctgataatcgtgcatcaggaaaaaccacaaaatcgggataaaggcggcgaccagcaacacggctacgccaatcagtttccagctcatacccgagaggaacaacacaaacaagccggaggcggcaatcagaattgaggtgccgagatcgggctgtgccgccaccagcagggtgggcaggaagatcagaatcagcgcaatgccggtatttttcagcgtcggcggacagacatcgcggttgataaagcgcgccaccattaaaggcaccgctatcttggcaatctcagagggctgaaaacgcacaaagccgaggtcgagccagcgttgagcgcctttactgatctgcccaaaggcatccaccgccaccagcagaatgacgcagacaatatagagatagggcgcccagccttcatagacgcgcggcggtacctgcgccagcacaatcatgatgaccagccccatcgcgatctgaccgagtttacgctccatcatgccggggtcctgaccactggcgctccagatcaccacagcgctgtaggtcagcaggccgagaatgatcagcataaacagcggatcgatgtggatgcgcatccagatcgaacgtttctgcggactatcttgcatcgacatgtttattcaccttcataaccgggcggcacaggagcggcgtccggcaggactgtattgttatcacccaacataatgtgatccagaatctggcgcatgacggtgccgacagccggaccggcgccaccgttttccaggataatggtcacggcgacccgaggtttgtcataaggggcaaacgcggtcattaatttatggtcgcgtaatcgttcagcaattttatgggcgttataggtttcgttctctttcaggccaaagacctgagccgtaccggacttagcggcgattttatagggcgcatcggcgaagctcttgtgcgcggtgccgttgggccggtttcgccacgccatacatgccatctttagcaatttcccagtagccggaatggatatcaccaatcggggcttcaggcggctggcgataaggtaccagggtacggccttcgcgggtggcgcgcagcatatgcggcactttgacgacgccgtcgttgatcagaatcatcatcgctttgttcatctgcaacggcgtagcggtccagtaaccctgtccgatccccaccggaatggtatcgccctgataccacggctttttaaagcgtctctgtttccagtcacgggtcggcatgttaccggcgctctcctgcggtaaatcgatgccggtacggctgccgtaaccaaatttattcatccactccgacagacggtcgatacccatgtcataggcaacctgatagaagaaggtatcggcagactcttccagcgctttggtgacgttcagacgtccgtggccccattttttccagtcgcggaagcgtttttctgaaccgggaagctgccaccagccgggatcaaacaggctggtattacggttaatcacgccagcactcagggcagagaccgccacataaggtttaaccgtcgaagccggtggataggcagcctgaatcgcacggttatagagcgggcggttttcatcttccagcaggccgcggtaatccttactggaaataccgtcgacaaacatgttggcgtcatagcttggcgttgagaccatggcgaggatttcgccggtgcgcggatcgctgaccacgacggccgcgcgactgcccgccagcagggtctcgacatattgctgcagtttgagatcgatagtcagatagatatcacggcctgcctgaggggactcctcatgcagctggcgaatgacccggccacggttgttgacctcaacctcttcaaagccggttttgccgtgcagcaaattttcgtaataggcttcaatgcccagcttaccgatgtcgtgcgtcgcggcgtagttaggccatatgccctctttgtcgaggcgtgcaacgtcacgatcgttgatttttgagacgtagccgaccacatgcgtcagcgtggcaccgtaagggtagtagcggcgctggtaacctttaacttccacgccggggaagcggtactgattgaccgcaaagcgcgcgacctgcacgtcattcagaccagttttaaccgggatagaggtgaaccgacgcgagcgtttacgctctttctggaagttttcgaggtcgtcgtcagtcagctcaagaatcgggcgtaagttttccagggtctgttgcagattatctactttttccggaaccagttctgcctgatagatggtgcggttcagcgccagcggcgtgccggtacgatcgtaaattatgccgcggctgggggccacaggcaccagtttgatacggttttctggttggagcgggtgctgtaatcatcaaagcgaaggatctgcaggtggtaaagattaaccaccagtactgaagagagcagtaagataccgacgaaggcgataaaggcccgacgtacaaagagtttctgttcggcgctgtaatcgcgaaaggcgttgctttgtaatttcatccgctacttgtcatgtctgatgtgggctgatcggtcattcacgatgataaggatgatttgtcgttatgctccaggcccgatacagactttcggctaccagcacgcgcaccagcggatggggcaacgtcaatgctgacagtgaccagctctgctctgccgccgctttacaggcgggggccaggccttcaggcccgccaatcagcaggctgacatcgcgaccatccagcttccagcgttcaatctgctgtgccagctgcggggtttcccacggatgaccaggaatatccagcgtaacgatgcgattgcctttgccgaccgccgctaacatcgcttcaccctctttttcaaggatgcgtttgatatcagcatttttaccgcgtttacctgcggtcacttcggtcagctcaagcggcatatctttcgggaagcggcgcagatattccataaaaccggtctgcacccagtcaggcattttcgtgccgacggcaacaagttgcagtttcaccgattagccccagagtttttccagctcatacagctggcgactctcttcctgcatcacatgcacgatgacatcacccagatcgaccacgacccagtctgccgcgcttttaccttcaatgcctaatggcatcaggcctgctaaacgcgactcctgctctacgtgttctgcgatcgaagtcacatgacgcgtggaggtgccggtgcagatgatcatgaaatcggtgatgctggatttgccctgaacgtcgatggtgacaatgtcctggcctttgagatcatcaatcttatcaataacgaactcttggagtgctttaccttgcaaaaggttccccttggaatctggtggtaacgagccggctgtaagcccggagagtgcagccaaaaaattaagcggcgtagtatagcatgcccggatcagtcgcgatataagccttcgcggtcgatataatcgataaccgcagcgggcaacagatcgtcgcagggctgattctggtggcgacggcggcgaatttcagtggccgaaatgtcatagagaggggtgtccgccagccagatatggcctgcgggctgctgatgcagctgccggatatcctgagcgaggtgttgctcaagccagcgctgcatgtcaggcgagtcgaaccgggtcggatagccggggcgctggcacaccagcagatggcagagtgacagcagatcctgccagcgatgccattttgataagctcagcaatgaatcctgaccaataataaaccccagcggctgttctgcaccgcgttcggtgcgccaggcttccagggtggtcacggtccaggacggcgtgtcgcgttccagctcgcgggtatcgatctcaaacagcggcaggtcgcggatagcgcagcgcagcatagcaacccgctgggcagcgctggcttccggttgcggacgatgcggcggtacattgttgggcagcagcgtcacacgctgcaggccggtctgttgcgccagcgcttcgaccgggcgcagatggccaaaatgaatcggatcaaaggtgccgccaaacagtgcgtgtaactcagacatgggcaaagctcgtcggaaaagcacgactgctgagcagcagcgtcagggtctgtaactgcggccacaccggctgtccataatcctgcttcagggtgatctcaatctgactcagcagatgaatggcgcgttgcagacgcgtggcatccagtcgttgcagcgcgtcggtaaacagcgcacggcggtttctgccagatgcgctgctgatccatcagcgtacgaagcggctgcgctgtctggtggcgttgcagatgcagcagcgtcagcagatcacgctgcagcgtacgcagcagtatcaccacttcgctctcttctttctccagctgatgcagaatatgcagggcgcggcggctttttcccgccagcagggcatccacccagtggaaaggagtaaagtgcgcggcatcactgaccgcctcttcaacccggggcagggtcagcttgccgtcgggccactgcagcgagagtcgctccagcgcctgcgccagcgccagcagattgccttcatagcagtaacacaacagttgcacggccgcgtcatctaccgataacttcagcgccttagcgcgattaacgacccagcgtggcagttgcgcctgttcaggcgtctgacagggcaccagtaccgcagaggcggacaacgctttaaaccaggcgctgttttcctgcgctttggtcagcttcgccatccggcagatcagcagaatatcggcgtgcagcaactgcgacagcttaaccagctgttctgccatcgcggcgttagggccattatcggggaattgcagcgtcatggtctgacgctgagcaaacaggctcagtgactggcaactgacgaacaggctctcccagtcagtctgtgcatccagcgtaaaactaaaatgttcttcgaatccctgcgcggttgcggcgacgcgaatcgcatctgaactttcctgcagcagcagcggttcgttaccggctaacaaataacaggcgcgcagcccctcacggagctgcgcgctgagttgctcaggataaatcctgatcattgcaggctggtagcagaggaagtgggcgcttcctgtgaaccctgacccggcaccggaatcactgacgccggtaaggtctctttgctgttgatctgcgcggcgtgtaccgtcagcagtttacgtaccagctgttcagcagcacgctgacgcatctcctgcgtaatcagatcctgctcggcatcttttgccagcgcagcgttcgggttatcgaagaatgaccgataaaccgtggtgctgataggatagatacctttgcccggcagcagcacctgcgccgtgagggtcatcaccagctgatactcggcagtggtgccgctgataaagaccgaagccgtgttacggcccgaggattcaggccccaggcgcagcgtcggaatatcggtgcgattctgtttgctgtcttcaacaattttgacatcgttgatacgcagctgctgacgcacagtacgcgccagcggcccataaggatcgccggttgaaacaatcagggttttcagtttcgctgggcacctgagtggtgccgcgcggatgaaaaccacagccagcggtgatcaccaccgccagcatgacaaacagcctgataatcggatgtcgcacagttcctcctgaacttaacctacgaccaggttaagcagtttgcccggtacataaatgactttacggatagtcacgccgtccagatacttcgctaccagatgctcctgcgcagcgcgtgcctgaacctgttcctgtgttgcatcggctggcacggtgattttaccgcgcactttaccgttaacctgaaccactaccagcagcgaatcttcaaccatagcggcttcatccgcaaccggccagctcgcttcatcgatagtgccttcgccacccagcgtctgccacagaacatagcaggcgtgcggggtaaacggatagagcagacggacgatggccagcagcgcttcctgcatcagggcgcgatcctgctcgctttcctgcggggcgcgtgccagtttgttcatcagctccatgatcgccgcaatggcggtgttgaaagtctgacgacggccaatatcatccgccactttggcgatggttttgtgcagatcgcgacgcagcgatttctgctcgtcattcaggctctccacatccagtgccacggtcgcacctttctgtgtatgctcgaagaccagcttccagacacgtttcaggaagcggttcgccccttcaacgcccgactcctgccactccagcgtcatatccgccggtgaagcaaacatcataaacagacgcacggtatccgcgccgtaacgctcaaccatcagctgtgggtcgatgccgttgtttttcgacttcgacattttgctcatgcccgcgtagatcacttcgcggccctgcgtgtctgtggctttaacaatgcggcctttctcatcccgctcaacctcaacgtcaaccggtgaaacccagttacgctcgccgttggcaccaaggtagtagaaggcgtcagccagcaccatgccctggcacagcagacgtttggctggctcattggagttcaccaggcccgcgtcacgcagcagcttgtggaagaagcggaaatacatcaggtgcatgatggcgtgttcaataccgcccacatactgatcgaccggcagccagtagtttgccgctgccggatccagcatgccttccttgtagctggcgcaggtataacgcgcgtagtaccaggaagactccataaaggtgtcaaaggtgtcggtttcacgcagggcaggctggccgtttaccgtggttttagcccactccggatccgctttgattgggctggtaatgccatccatcaccacatcttccggcaggatcaccggcagctggtcttctggtgcaggcataacggtgccatcttccagcgtcaccatcgggataggggcaccccagtagcgctgacgggagacaccccagtcgcgcaggcggtagttcactttacgcacgcccacgccttttgccgccagcgaatccgcgatggcgttaaaaccggtggcgtgatccatgccgttaaactcacctgagttgaacagcgcacctttgtcagtcatcgccgcaatgctgacatcaggaatggaaccatccagattcaggatgaccggcttaatcggcagatcatatttagtggcaaactcccagtcgcgctgatcgtgcgccggaaccgccatcacagcgccggtgccatattccatcagtacgaagttggcaacccagaccgggataagctcgccggtcagcggatgaacaacagacaggccggtcgccatgcctttcttctccatggtcgccatatcggcttcggccactttggtattgcggcattcagcgataaagtcagccagcgccggattattgaccgacgcctgggtcgccagcggatggcctgcggcaacagcaacataggttgcgccgataaaggtatccgggcgggtggtgtagacggtgaccttctcttcgctgtcagccacatcgaaggtgatttcgacaccttcagagcggccaatccagttacgctgcatggttttgacctgctcaggccactcttccagcgtatccagatcgtttagcagctcctccgcataatcggtgattttgataaaccactgcgggatctctttacgctcaactttggtgtcgcagcgccagcagcagccgtcgatcacctgctcgtttcgccagcaccgtctgatcgttcgggcaccagttcacggcagaggtctttttatagaccaggcctttttcatacagtttggtaaagaaccactgttcccagcgatagtactctggctggcaggttgccagttcacgactccagtcatagccaaagcccagcagtttgagctggtttttcatgtaggcgatattgtcgtaagtccacggcgccggagcggtgttgtttttcaccgcagcgccttccgcaggcaggccgaaagcatcccagccaatcggctgtagtacgtttttgccgagcatacgctgataacgcgcgattacgtcgccgatggtgtagttacgaacgtggcccatgtgcaggcggccagaaggatagggcaacatggagaggcaatagtatttctctttaccttcctgctcagtcactttaaacgtttcgttttcatcccagtgctgctgcacacgggattcaatttcttccgggcggtattgctcttgcatggctgcctgtggtcctttatgaaaaacatttttctggctctaagatccgcatagcatacccataaggccgcgtatcaacaacacttcccacttttgccggcacgatttctgccgaaagcgtcagagccttcacccttttgtaattcactgtacagacgacacggcaaaagcaacattacgactaaacttagttcagcgagggtctgcataaaggagaacaaaatgaataaagtggctcaggaatatcgcgagtcgttagccgtattgaccgaacgtcttcgtcagggcgatcgtaaccttgatgagctgattgccgggcgacgaagccagttgctggtgcgcgatgatatgacggaacaggagattgaccaggcgctcagctcagtgcgccgtgatctgggcgagtttgcacgcagctacaccgatgtggaagaaccgctggcggactcactgtttatgcgcattatccgcgagagcgtctggaaagagctggcggatatcaccgataaaagtcagctggagtggcgagaggtcttccaggatctgcatcatcacggggtttatcagagcggggaagtggtggggctgggcaatctggtctgtgagaaatgccagttcacccgggcaatctacacgcctgaaacgctgtcacgttgtccggaatgcggcaacgatcagttccagcgtcagccgtttgaaccctgatagtgcggcgtagctaaatgaagcgggccaccctgggtgacccgcctgtttcgtcaggtttagtgcagaatttttgcgaggaaatctttagcgcgctcagactgtgggttattaaagaagtcatctttgttggtgtcttcgataattttcccttcatccataaagatcacgcgattggcaaccttacgggcgaagcccatctcatgggtcaccaccatcatcgtcatcccttcctgtgccagttcaaccatcacatccagcacttcgttgatcatttccggatccagcgcggaggtgggttcatcaaacagcatcgctatggggtccatacagagcgctctcgcaatcgccacacgctgctgctgaccacctgaaagctggccgggaaacttctcagcatgggcggatagacccacacgcttcagcagcttcagccctttatcgcgggctgccgctttgtcgcgcttcagcactttcacctgcgccagaaccaggttgttgataatgctcagatgcggaaacagctcgaagtgctggaacaccatcccgacctggctgcgaagctgcgcaagattagtctttttgttattcacctcggtgccgttcaccgcaatcacgccctgctgaatcggctcaaggccgttcaccgttttgatcagcgttgatttaccggagccggacgggccgcataccaccaccacttcaccggttttgacgtcggttgagcagtcggtcagcacctgaaagtgaccataccacttagaaacatttttcaggctaatcatttaaaccgtcctttttctttttagatagctgaccaacagcgatgcgctcaggctgataacgaagtagaccagacctgcaaacagaaccatttcaacctgggtgccatcacgctcaccaatggtggatgcggtacggaagaagtccgccaggcttaagacataaaccagcgaggtatcctggaacagcacgataccctgcgtcagtaacagcggaaccatggcgcgaaacgcctgtggcaggatgattagtcgcattgcctgccactgcgtcatgcccagcgccagagccgcactgccctgtccacgcgagatactgatgatgccggcgcgaataatttcagagtagtacgccgcttcgaacagcgaaaaggcgaccatggctgaaatcagtcggatatccgttttgggcgacagccccagcacctgctgcagaaaactcggcacgaccagatagaaccacagcagcaccataaccagcggcaccgagcggaacaggttgacgtaaattttagcgaaccagctgataggcttaaacgtcgacaggcgcatcaccgccagcagagtgccccacaggatgccgaagaccacagcggtaatcgtgatcttaaaggtgatcactaagccattaagcagatagggcaggctgggtgtaatcgaactccagtcaaactcgtacattacttgcctcccgcattgcctggcagccggactttgcgctcgaccagactcatcaacaacataatcaccaggttaatcgcaacgtaggccagcgtaatggcggtaaaggattcataggcgtgggcagaatagtcgagcagtttgcccgcctgcgccgccatatcgaccagaccaatggtggaggcgatagcggagttcttcaccaggttcagcatttccgaggtcatcggcggcacaatcacgcgatacgcattcggcagcagtacatagcgataggtctgcggcagggttaagcccatcgccagaccggcattcttctgtccactcggcagtgactgaatcgctgcgcgcacctgctcgcagacgcgggcggcggtaaacaggccaagacagatcatcgaggagaggaagaactgaatgttgggatccagctcagacttaaaccacatgccaagcttttcgcccaccagctcgggcgccaccagataccagaagaagaactggacgatcagtgggatgttacgaaacagttcgacatagcaggtgccaatggtcgacagcaggcgattaggcacggtgcgcagaatgccgaaaaatgaacccacacagaaggcgataatccaggcgcagcaggagacggcaattgtcacctgaaaaccggaccacagccagccgaggtaggtcgtgttaccgaacggggcctgttcgaggaatatgccccagttccaatcgatacccataacgagctccggaaaaaaagggtagctaagctaccctgaagattgatgaacggcgttttatttcctgactcaggggaacgacccgtgtcagtctgtctgtccatgccgcggtttcagcaatcgagagggcagccaggccgcccttgttatacccgtcgtctttcaggatgcatttttgttggctacattcactcacccgaatcacttaccggagtaggctcatcgggagtcatttttctgctgcctcaatgcaatctgaaatccattgggtatttttttgttaattcagtgctttatcatttggtgttttgaacagcgctttcatgtcatcagagagctcaaagttcatgttcaggttctttggtggaatcggctgtttgaaccaggtgtcgaaccatttttctgcctggccagaggtctgggctttggcaatggtttcatccaccagggctttgaactgcggatcatctttacgcagcatgcagccataagcctcttttgactgtggcgtgcccaggatttcccagttgtccggctttttggctttggcgcgttcgcctgccagcagggcatcatccatcataaaggccacggcacgaccggtttccagcgtacggaaggagtcaccgtgatcttttgcgctgatgatgcgcagatccagtttctgttcgtcgttgagtttgtgcagcagcacttcagaggtggtacctgaggtcaccactacggttttgcctttcaggtcagcgaaatctttgatcgggccatctttcttaaccagcagacgggtgccgataacaaaaatagtgtctgagaaggcggcctgtttctggcgctcaaggttgttggtggtcgatccacactcataatcgtaggtgccgttttgcagcagcggaatacggttttgtgaggtgatcgggatcattttgacctgcagatcaggcttgttcagctttgctttaatcgcttcaacgatggcgtttgagtaagcctgtgagtagccgacgactttttgctggttgtcataataagaaaagggaactgatgattcgcgatgcccgaccacaatgacgccattgtcattgatcttcttcagggtgccgctgagatcttccgcctgggccgctcccgccgctgcgctgatcagcagaagagataatgccactttgcgtagttgcatgttccaactccttcgtatgaaaaaggcacaggatataacctgcgctgattatgatgttgtgtctgttttctgctgcgtttctgctcattctgcggtttaaacgggcgcagaagagtcattaacatagcggattgttaacgcaatgaaacaaaaaagtttcttttttgcgaggtgatacgcaccaaaaaaaggcaattttttcaccctgcgcgttaatggtgcagcagcgtcaattgttttggtgcaacccgcccggcatcagcgcctgcaatcagcctgtttgcgaaaagcagtgaaacattttgcaatcatcgtgccagaaagaggttatgcgttagaaagacagcagagtgtgcggcgtggggagtgaaaaaaaccggagagtcaccatgaaaaaggcgaagcaggtgcttcgccttcagtgagcacaggaggggaggttatcgacgccgacgcaggagtgctatcaccgccgccagcagcgtcagtgaccacactggccagatgccagctcgcgcatacggggtttctccctgcgttggcgtaaccttgctggtcagcacatcgcgggtaaactgcggcagcatggcttccacatcaccactggcattgaccaccgccgtcacaccattattggtgctgcgcaacagcggacgtcccagttccagcgcacgcatcctcgccatctggaagtgctgccatgggccgatagagtgaccaaaccaggcatcgttcgaaacggtcaacaggaagttggtgtcgggatggaagttggcccgcacctgttcacccagcacgatctcataacagatggcgctggtcaggttatagcccgccacgctaagttgtggctggaggtagttgccacgactgaaggccgacatcggcagatcgaagaacggggccagcggacgcagcagatcggccagcggcacaaattcgccaaatggcaccaggtgattcttctggtaacgattgccgctgaagtagttgtacggcgctttgccgcccagcacgatcacggtgttgtaatcgtgatatcggttctgctccagccgggagtccacaatgccggtgattagcgagctgccgcgctcacgcagttcgtcatccagcgaacgcaggaacggctgctgattactctccagatcggtaattgccgattcaggccagataataatcggcgctttgcccatcagcggctgactcagaccgttgtaaatgcgcagggtagtgagtaactgctgcggatcccacttcatcgattgcgggatgtatccctgcaccagcgccacctcgacggcccgctcgggcatcggctgaacccactggatgtagcgcaacggccatggcaatgccagcagcagcagcgctgctcccagacttctgacgttgcgctgttgcagggcataagccagcaggccagccaccaccatcagcaggaaggtcagcgtctctacgcccgccagcggggccaggccttttaacgggccatcgatctggctgtaaccaaactgcagccacggaaagccggtcagcacccagccgcgcaggaactcggtgatttgccacaatgccggtgccgccagcgccaggcgccacagcgtcgttcgcggccagatgcgattcagtacgccggcaaacagcgccgggtagatcgccagataagccgccagcagcgccacgataaagacattgaccgggccaggcatgccgccaaaggtggcgacactgacataaacccagttgatgccactgccgaacagacctaaaccccagacaaacccaatggcgctggcctgcgggctggagcggttaagagtcagcagctgtaagccgcacagcgagagcagtgcggcgggccagaaatcgtagggagaaaaggcgagggtgccaagtgcacccgttattaaagccagcagcaggcgaacccgctgacgcgggtagagtgaggctaaagccatagacttattcgtcttccagttgaggttgtggcgaattttccggaatagtcacgtgaacctggatgatgcggcggctgtcagccatcgccaccttgaactggtaaccctcaatctcgatgctttcaccgcgagcgggcagatgaccgaagccctgcatcaccagaccaccgatggtgtcgacttcatcgtcgctgaactgggtgccaaacacctcgttgaaatcttcaatggcagtcagtgcacgcacggtaaaggtgtgacggttgagctgacggatatcacgatcttcttcgtcgtcatactcatcttcaatttcaccgacgatcagctccaggatgtcttcaatggtcaccagaccggagacaccgccaaactcatcaatgacgatcgccatatggtaacgctgggagcggaactctttcagcatccggtcgacacgcttactttcaggcacaaccaccgcaggacgcagcactttctcaatgctgaaaggctcagattcgctgctcataaacggcagcagatctttcgccatcagaatcccttccacatgatctttatcttcgctgatcaccgggaaacgagaatgggcggattcgatgatgacatccagacactcttcgaggctctgattacgtttcagggtgatcatttgcgagcgcgggatcatgatgtcacgcacgcgctgctccgcaatatccagtaccccttcgagcatgtcgcgggtgtcctggtcaatcagctctttgttattcgagtcgcggatcagctccagtagctcatcacggctttttggttcaccgtgaaagagttggttgatcaacagggagaaaaatccctttttactactgggtgcatcgctgttttgagaatggtcgtcgctcatggcggtttttatagatctctctggtgaggaataggtgctgtcagtagcctgtactgacagcaggattgactgaattcaggattcaggcgtcttctttctccgaaatgtacggatcaggatacccaagagcaagcattatctcggtctccagcccttccatctcgtccgcttcgtcgtcttcaatatggtcgtaacccagcagatgcagcgtgccgtgtaccaccatatgtgcccagtgggcttcagcgcttttaccctgttcagcggcttcctgctcaacgacctggcggcagatgatcagatcgcccagcagcggcagctcaatgcctggcggtgcttcaaacgggaaagagaggacgttggtcggcttgtctttgccgcgataagtcagattaagctcatgactctccgcttcatcaaccagacgcaccgtaacttcgctttcgggctgaaaaggggtgacagccgctgacagccagcgatgaaactggctttcagcaggcaggtcagcggtgctgtcacaggcgacctgcaggtcgagaatcacctcgctcatttgctctcctgcgtggcgctctgtgcagccagtgcttcacgtttacgctcttcggcctgctggtcacgacgggtctgatcggccgcttcccaggcttcataggcggtgacaatgcgggcaaccaccggatggcgcaccacatcttcgctgtggaagaagttgaagctgatctcttcaacgtccgccagcacctcaatggcatgacgcaggcctgacttaacgtgacgcggcaggtcaatctgggtaacgtcgccggtaatcaccgctttagagttaaaaccgatacgcgtcaggaacattttcatctgttcgatggtggtgttctggctctcatcaagaatgataaacgcatcgttcagggtacgaccacgcatgtaggccagcggggcgacttcaatgacgttgcgctccatcagcttttccacccgctcgaagccgagcatttcgaacagcgcatcgtagagcggacgcagataagggtcgactttctggctcagatcgcctggcagaaagccgagcttttcacccgcttcgacggcagggcgggtcagcatgatgcggcgaatttcctgacgctccagcgcatccactgccgcggctaccgccagataggttttaccggtacccgccgggccgacaccaaaggtgatatcgtggtcgagcacattagcgatgtactgggcctggtttggggtgcgcggcttgatcacaccgcgtttggtcttgatattgaccgctttaccgtactccggcacgctctcagcggtttgctccagtacccggctctctttgatcgccaggtgaatctgatcaggctcgatatccgggatgtcgccacgcacaggcgcggtatcgacatagagggttttcagaatatctgctgccgcattgacgcaaagtggacgtcctgacagcttaaaaacgttgtcgcgacgattgatctcaatgcccagacgacgctcaagctgttttacattatcgtcgaaaggcccacacaggctcatcagacgacggttatcagccggttcaagggcgatttcacgagtttcgatattcaaacgaatcctttgggtcactcagggccagttatgggatgtgtctgacgcaccgttaagcttaaccggatgcaccataacgaaattatttatgccgtaacgcctgggcgcaagcttatggagagatatttgggcgacactttcagaaagcaagtggtgcaaagtgaaattggcggcaacgcgatgcgcgctgccgcacagtaaagcgggcatcacggctggaacagactcacgccgatttcattttctttacgggtacgggcgatcacggacgccgggctttccgccatgcgcagccccatctcttcttcagtacgcaccagtttgccgcgcagcgagttggtgtagacatcgacaatttcaacatccacaaagcggccgatcatttcaggcgagccttcgaaattcaccacgcggttattttcggtgcggccagagacttccatcacgtttcttgcgggagatgccttccaccagaatacgctgcactgtgcctaccatgcggcgactgatcgcctgcgcctgctggttaatgcggtcctgcaggatccacagacgctgctttttctcctcttcgctgacatcatccggcaggtcagcggcaggcgtgccgggacgggcagagtagataaagctgaagctgacgtcgaaattgatctcggcaataagcttcatggtctgctcgaaatcctgctgagtttcaccggggaaaccaatgatgaagtcagagctgatctcaatatccgggcgcgccgcgcgcagcttgcggataatcgccttatactccagcgcggtatgagcacgcttcatcagcgtcagaatacgatctgatccactctgaaccggcaggtgcaggaagctcaccagttccggcgtatcgcggtagacctcaatgatgtcatcggtgaactcaatcgggtggctggtggtgaagcgaatgcggtcgataccgtcgatggcggcgaccaggcgcagcagctcagcgaaggtacagatttcaccatcaaaggtggcaccacgataggcgttaacgttctggccaagcaggttaacttcacgcacgccctgcgctgccagctgagcgatctccagcagaatgtcatcgctcggacggctcacttcctcgccacgggtgtaaggcaccacgcagaaagtacaatatttgttgcagccttccatgatggagacaaaggccgtcgggccgtctgcgcgcggttccggcaggcgatcaaatttctcgatttccgggaagctgatgtcgaccaccgggcttttggtgccgcgcacggtgttgatcatctccggcaggcggtgcagtgtctgcggaccaaaaacgatatccacgcagggcgcacgctggcggatatgatccccttcctgcgacgccacgcagccgcccacgccgataatcacatccgggttgcgctctttgagttttctccagcgtcccagcaggtggaatactttctcctgcgctttctcacgaatagaacaggtgttaagcagcagaatatccgcctcttcaggaacctcggtcagcgtatagccgtgcgtactgttcagcagatcagacatcttggatgaatcatactcattcatctgacatccccaggttttgatatgcagtttttttgtcatcgcgctaaccattgattcagtgcagtgaagtgcggggcgcgtattgtaatgctttgatgctgttgtgaccagcctcagggcttttctgccagcaatccggttttccggtacactttgctttattcagacccgtgttgcgcaggctggcgggaataagagagggacataagcaatgcaggataatcagtttgatgtagtgattgttggcggtggcatggtcggtgcggcgctggcctgtggactgacgcagcaacattttcgcgttgcggtcattgagcgtgccgaacccgcgccttttgatgccgacagcgatcccgatctgcgaatttcggcgattggctcatcctcggtggggttgctgaagcagctcaacgtctggcctcgggtagaggcgatgcgcagcgcgccctatcgcaggctggaaacctgggagtggcagacggcgcaggtgagttttgatgcggcctcgctggggctgcccgagctgggctttatggtcgagaacagcgtgcttcagcgggcgttatgggaggagatgcagtcgctgggcgtgacctgctattgcccggccacactggagaacctgcagccagaaaatggcggctggcgcatcgacctcaacgacggcgttgccttacacgcccgcctggtggttggggctgatggcgcgaactctcaggtgcgacagatggccgggatcggtattcatggctggagctatgcgcaatcctgtttactgatcagcgtgacctgcgaacatccggcaggcgatgcgacctggcagcactttacgcctcagggaccgcgcgccttcttgccgctgtatggcaaccgggcctcgctggtctggtatgacgcgcctgcaagagtccggcagctacaggcgatgccgatggcccagctggaaaaagagatagccagccatttcccggcgcggctgggacgttttaaagcccacgcggcgggcggcttcccgctggtgcggcgtcacgcttcacggtatgtcctgccaggactggcgctggtcggtgatgccgcgcataccattaatccgctggccgggcagggcgtgaatctgggctatcgcgatattgatgcgttgattaatgtgctggtcagcgcacgcggtgcggcggaggattgggcatccgagcgcgtattgcagcgctatcaccggcaacgtcgtaaagacaatatgctgatgcagggcggcatggatctgttctattttgccttcagcaatcagctggcaccgctgcggtttgcacgtaatctcggattgattgccgccgaacattccggagtactgaagcggcaggtattgcgctacgcactggggttatagcagattgcgcatgtcggctcgccgcacggcgggcctgcaatcaggaaggggaacgacaaaaacaacaaagcccgcaaaagcgggccaggttgtgcaatttggctggggtgcagggattcgaaccccggaatgctggtatcagaaaccagtgccttaccgcttggcgacaccccaataatggtgtttttcaaattgtcttttgtatggctggggtgcagggattcgaaccccggaatgctggtatcagaaaccagtgccttaccgcttggcgacaccccaattatatggtggctacgacgggaatcgaacctgtgaccccagcattatgagtgctgtgctctaaccagctgagctacgtagccaaattgtactgcatttcaatgatggctgggatacctggattcgaaccagggaatgccggtatcaaaaaccggtgccttaccgcttggcgatatcccattcgtccgttctcagcctcgagaatcatcgaaattggctgggatacctggattcgaaccagggaatgccggtatcaaaaaccggtgccttaccgcttggcgatatcccatccacgctgccgaataatgaaatggtgcgggaggcgagacttgaactcgcacaccttgcggcgccagaacctaaatctggtgcgtctaccaatttcgccactcccgcaaaaaaagatggtggctacgacgggaatcgaacctgtgaccccagcattatgagtgctgtgctctaaccagctgagctacgtagccatctttttttcgcgttaccttcatcggcgttgcggggcgcattatgcggagttgaccagacagcgtcaacaatttttttaccgttttttgccagataatcgctgtttgactggcttataaccagcctggatgtttattcggcaatttttcagtgaatacaacgctaatcgtaaaaaaaatgggccacaacgggcccattcttgttgctttctgccggcttatttataggctgactgatgcacacccacggcacgaccagagggatcgtccatgtttttaaacgcttcatcccattcaatcgctttggcagaagaacaggcgaccgatggaccgccgggcacacactctgccgcgctcgccagcgggaacagctcttcaaagatctcacgatagagataggcttctttcgaacccggcgtgttgaacgggaagcggaagtgagcggtagccagctgctgatcgctgatttgcttcgcagccacttctttcagtgagtcgatccagctgtaacccacgccatccgagaactgctctttctgacgccacgccacgctctccggcaggtaagaggagaaacattcacgcagaatgtgcttctccattttaccgttgctgccacacattttatcggccgggttaatacgcatcgccacatccaggaattttttatccaggaacggtacgcgggcttcaacgccccaggcggacatcgctttgttggcacgggcgcagtcgaacatatgcagcgcctgtagtttacgtacgttttcttcgtggaactctttggcgtttggcgccttgtggaaatagagatagccgccgaagacttcatctgcgccttcgcccgacagcaccatcttaatgcccatcgctttaattttacgcgacattaagtacattggcgtagaggcacgaatggtggtgacgtcataggtttcaatgtgataaatcacatcgcgaatggcatccagaccttcctgcacggtgaaatgaatttcatggtgtacggtgcccagatgctccgccaccgatttcgccgcttttaagtcgggtgaaccttccagtcctaccgcgaaggagtgcagctgtggccaccacgcatcacttttatcctgatcttcaacccgcttcgccgcgtaacgcttggtcacggctgaaatgatggaagagtccagaccgcctgacagcagcacgccgtaaggcacatctgacatcaggtggcttttcacggactcttccagcgcatgtttcaggccagcggcgtcggtggtgttgtgctcaacgtttttatattccatccagtcgcgctgccagtaacggcggatctcgccatcggtgctggagaggtagcttcccggcgggaactctttgattgaacggcaggcaggtaccagcgctttcatttctgaagcaacaaacaggttgccatgctcatcgttacccatatagagcgggatgatgccgatgtggtcgcgaccaatcaggtacgtttttttaacggtgtcatagaggataaaggcgaacatgccttccagctcatcaaggaaatcgacacctttctcctgatagagcgccagaatcacttcacagtcagaaccggtctgaaacgcgtagcgatcgctgagttcagcgcgcagtgcctgatggttataaatttcgccgttaactgccagtacgtgggtgtgatcggcgttgtacagcggctgtgcgccattgttaacgtcaacaattgagagacgttcatgcgccagaatagcatggtcatcggcgtagacgcctgaccagtccgggccgcgatgacgcattaagcgtgaacattccagcgcttttttgcgcagctcaacaggatcggttttcagatccagcacaccaaaaattgaacacataactgactcctgagctcaccttacggcgatgttttcttttgcgtttgtccggcagcctgatgctgcgtgatacataagaaaatgcgctatttggtgcattcaatgcaagaggaatcgtgatttactgataaaaagattgcttgcatggcaataaaattaaataaacgataattttaaagccgtttcgttgctggatcagcaataaaatagcttttgtgagcagaaatcagacagtaaaagtgggagatatagcgcaaaaaggggggacgcatcacagattagccggatgcgtcataagagaaatgaatcagaacaggtcaatatcggccacagaagggtagatccagtccggacggaacggcatggcatcgatatcactcagcgtcgagacgccggagagcaccagcaccgtctccagacccgcctgaaaaccggccagaatatcggttcgcagattgtcaccgacaatcacggtctcttccgagtgggcctgcattttgttcagcgcggcgcgcatgatgtaggggctgggcttgccgacaacaaacgggcgacggcctgatatcttctcaatacccgcacagagtgcgccacaggcaggaataaaaccgcgcgcatgggtatccggattggtggcaataaagcgagcgccattagccacgaagaaggccgctttatgcatcatgtcccagttaaacgagcgcgtctctccgacaatgacaaaatcgggattcacatcggtaatggtaaagcccgctttgtagagttcatgaatcagtgcgccctcaccaatcacatacgcctttttgccctcctgacggcgcaggaagtcggcggttgccattgcggaggtatagaaaacggagtcgggcacctcgacaccggccgaggcaaagcggttagccagatcctgctcggtttgcgagggatagttcgtcagcaccaccagcggcatctctttggccagaatgcgctgtaaaaactcctgtgcgccgggaacggccgtgttgtcgtgcatcagcacgccatcgatatcacaaattacgcttttaatggtcatagtcagatccgatatggcccgccacagcagcgggttagcttagtcttccagaagatgttgcagcagaatgccgttaagcatggcacgtttagcgagcgcaaaggcgccaatagcggaacgatgatccagggtggaacgcacgaccggcagatttttacggaaggcctctaatgcctgagtattaatgcagccctcaatcgcgggcagcagcactttttctgcttcagtgatctcacccgccagcaccactttttgcggattaaacaggttgatcgcaatcgcgatagctttgccaagataacggccaacgtgctcaaccacttcgcaggccagtgcatcaccctgattggccgctttgcagatgtgggatatctggcacgcctccagcgtcagtacgctgggatagccctgattcagcagatggcgtacccgattttcaatggcgccgttggcggcaatggtttcaaggcagccaaagttgccgcagtggcagcgctcgccaagcgggtcgacctgaatatgaccgatttcgccaacgttgccgttgctgccgagaaaaatatggccgttggcaataatgccggcgcccgtgccccggtgtaaacgcaccagaatcgagtcagcacagtcgcggcttgcaccgaaatagtgctcggccagcgccaggctgcgaatatcatgacccacaaaactggtaacgttaaaacgttttttcagactggcgaccagcggccagcggctgacagagatgtggggcatataacggatcacgccgttaatcggatcgaccagccccggcaggatcactgaaatcgcgatcagctcgcgaattttacgctggtgctgctcaatgaagctgctgatggcgttaaacagcgcatgttccagcgtctcctgagtgcgtttccggcagcgcataatcttcctgcgccagcgatttaccgctgaggtcaaacagagtcagggtggcgtcgttgcgtccgaggcggacgccgatggtatggaaatggcgggtttcagtgataatggagatggcgcggcgaccaccggtagacgcctgctggtctacctctttgatcaggccgcgctcaatcaactgacgggtaattttggtgacgctggcgggcgcgagctggctaagttcggcaatctgaatgcgcgatatcggcccctgttgatcaatcagccggtaaaccgctgcgctattgagttgcttaacaagatcgacatttcctatttgtgactggccgccagtggtcattcagtgcttactcgctcaggacgtcgtctccgttgacaaacgtctttatgattttaaagtcgcgcgtaaacacagtcaggttcgcgatttttcctgcttcgatcgagcctgactgcctttccacgcccatcgcccgtgccgggtagagtgttgccatgcgcaacgcttcgtccagtgcgatccctgcatgctcaacgctgttttgtaccgcttcaatcatcgtcagggcagaaccacttaatgtgccgttttcgtcgacacagagcccatcgcgataatagattgttttgcctgcaaaaataaactcgcttatgtccgcgccagccggtgcagtggcatccgtgaccagcaccagtttgtcgcctttgatgcattttgcattgcgcacgttagcgtaatgtacatgtaaaccgtccgcaataatgccgcagtatacatcaggcgaatcaaacagcgcaccgataagcccgggttcacgtccggcaaaggtgggcatggcgttgtagaggtgcgtcgcgaaactcacaccagcagaaaagcccgctttagcctcttcataggtcgcattcgagtgaccggctgagacaataatcccggcatcagtcaattgacgaatcacatcgctacccgcattttcaggggcaagcgtgactttggtgatgacgtccgcgttgtcgcacaggtactgcaccattgccgcatccggcaggcgaatcagcgccggatcgtgggtgccttttttcgctttgctcagccagggcccttccagatgcagacccagcgcctgattctgatgtttctgcaggtaggcgcgcatggtttcaatcgcccgcttcatcagggcgtcgctgctggttatcagcgtcggtaaaaagctggtgcagccagacttttcattggcgcgctgcatcgtttccagcgtttcaatgctgagcgcctcaaggctgtcattgaactgcacgccaccgcagccattgagctggagatcgataaagcctggcgcaatatttgcccctgccatatcccgctgctcaatatccgccgggagggcttcacgcggacagacgcgtgcaatacgcccatcggcaaccaccaccgcgtgattatccagaacctcatggccactgtagattcgaccgttaactaatgcgtacatctctcttctcccgtcctggcctgctgtcactcagcgtaacagcagggcatgacaatgttctgttacacgcctttcatattttccgcttccatttcgcggaaatatttcacggttttcactttcagttccatggtggccggctcatcgcacactaccaccgatttcgcgtgcagctgcaggcagctgatggtccacatatgattaacgttgccttcaaccgccgcctgtaatgcctgcgctttaacatggccggtaaccagaatcatcacttcctctgcatccagcagcgtaccgacgccgaccgtcagcgcatatttaggcacctgatcaacgtcaccgttaaagaagcgggagtttcgccacgcgggtgtcatgggtcagggttttaatgcgggtacgggaagcgagagaggaagccggttcgttaaaggcgatatgaccgtcgttgccaacgccgcccatgaacaggtgaattttacccagcgcgcgaattttctcttcgtactgacgacattctgcgtcaatatcgggggcattaccattcagcaggttgatattttccggttgaatatcaacgtgatcgaagaaattgcgatacatgaagctgtgatagctctcaggatgctcctttggcaggccaacatattcatccatattgaacgtcacgacgtttttaaaactgacctggcccgctttgtgcatatcaatcaggtgtttgtacgcttccagtggcgtaccgccggttggcagacccaggacaaaaggtttatccgccgtcgggttaaacgcattgatacgattaacaatatgtcgggcggcccattttcccacctgggttggtgtcgctaaaggaatcagtctcatgtttcacctcaattgaaaatagaaaggggatggctaagccgttgcgtgagtcaccaatctgaacagatgattcattgtcgccatggccagcgcataattcaatatttcggatcataaaataagtttacggtcatagccagatgttgccgtatgaaacgatgttttttagtgataaaaatcacatttaccaggcttttaatttgcgaggcgaattaatttatcattacacttcgctgcgtgatatgaagtgtattaacgatctttgcagctgacataacaacattaagcagcgcaaagcgacaagtcaggctcatagggggaaggggatatgttaggttacttacaaaaggtggggcgcgcactgatggtgccggtagcaaccctgccagcagcagcgatattaatgggcgtgggctattggatcgatccagacagctggggcgcaggtaatgcgctggcggcattgctgatcaagtcgggtgcggcaatcattgagcacatgtcggtgctgtttgcgatcggtatagcctacggcatgtcaaaagataaagatggtgccgctgccctgactggctatgtcggctttctggtggtcaccacgctctgctcaccagctgcagtgtcgatgattcagaaaattcctttggatcaggttccagcagcctttggcaaaattgaaaaccagtttgtcggcatccttgtcggtattctgtcggcagaggtctataaccgcttcagccacgttgaactgcctaaggcactctctttcttcagcggacgccggctggtgccgattctcgtttcgttcctgatgatctttgtcgcttttatcctgatgtatatctggcccgtggtgtttaatggtctggttaactttggtgaacatatccagaagctcggctctgccggtgccggtatctacgccttctttaaccgcctgctgattccggtcggtctgcatcacgccctgaactcggtgttctggttcgatgttgcgggcattaatgacattcctaaattccttggcggtgcacagtcactagctgacggatcggcaactgtcggcatcaccggtcgttatcaggcgggcttcttcccgatcatgatgtttggtctgccgggtgctgcgctggctatctaccactgtgcgcgtcctgagaaccgcgtcaaagtgggtagtatcatgctggccgcggcgtttgctgccttctttacgggtattaccgaaccgctggagttctccttcatgttcgtggcacccgtgctttatctgatccacgccgtcctgactggtatttctgtcttcatcgctgccagcatgcactggattgccggatttggtttcagcgccgggctggtggatatggtgctgtcgacccgtaatccgctggcgacacactggtacatgctgatcccgcagggtctggtcttcttcgttatctattatgtggtgttccgctttaccatcaaaaaattcaacctgatgacgccgggccgcgagctggcggttgatggtgatgaaactgatggttatgacgttaacgttgataaaacggatagcggtgaaagtgccacagagtcactggcgcgccgctacattggggcgattggtggttcagctaacttaaccagcatcgatgcctgtatcacccgtctgcgtcttaacgtgaatgactcggcgcaggtgaatgaggcggttgctaagcgtcttggcgcgtccggcgtgatccgtcttaacaaacagagcgtgcagatcatcgtgggtacccaggcagaaagcatcgcctcggccatgaaaaaagtgctgaccaaaggtccggtcgctgcagcggctaccagcagtgcgccggccgagccggatgttaaaccgcaggcggtgctgaacagtgagaagcaggtcatcgccacgctgctggcgccggtcagcggtgaagtcgtggcgctggatgatgtgccggatgaagcctttgccagcaaagcggtgggcgacggtctggcgatcaagcccagcgacaaatgggtagtggcaccgattgccggtacgctggtgaaaatctttaacaccaatcatgccttctgtctggaaaccgacaatggcgtggagattgtggtgcacatggggctggataccgtggcgctggaaggtaaaggctttacccgtctggttgaagagggggccagcgtggtcgccggtcagcgagtactggagatggaccttgaattccttaacgccaatgcccgctcaatggtgagtccggtcgtggtcagcaacagcgacgatttcgccggtctgactttactggcacagggtcaggtaatagcaggggaaaccccgctgtatgaagtgaaaggctaatccccgcaacagaaaccccacaggcaggaagcgattcctgccttttttgttttaaaggcttaacaaacggttgtttccctcagacgctttgtggatcatactccgttacttcgtggtacaaatcacccgttattcgtattgaggatttttgagatgagtgaggctgaagcccgcccaactaactttattcgtcagatcattgacgaagatttggcgagcggtaagcacagcagcgtgcatacccgttttccgccggagcccaatggctatctgcatattggtcatgcgaaatcgatctgtctgaattttggcatcgcccaggactatcaggggcaatgcaacctgcgtttcgacgataccaatccggttaaagaggatatggaattcgttgaatccatcaagcgtgacgttcagtggctgggttttgagtggagcggtgaggtctgttactcatcaaactatttcgatcagctctacaactatgccatcgagctgatttccaaaggactggcctacgttgatgaactgagtccggatgcgattcgtgaatatcgcggcaccctgaaagagccgggtaaaaacagcccttatcgcgatcgcagcgtggaagagaatctggcgctgtttgagaagatgcgaaacggtgagtttgccgaaggcaccgcctgtctgcgcgccaaaatcgacatggcctctaatttcatcgtgatgcgcgatccggtgctttaccgcatcaagttcgcggaacaccaccagaccggcaagaagtggtgcatctacccgatgtatgactttacccactgcatctccgatgcgctggaaggcattacgcactcgctctgtacgctggagtttcaggacaaccgccgtctctatgactgggtgctggacaacatcactattccggttcatccgcgtcagtatgaattctcgcgcctgaatctggagtatgcggtgatgtcgaaacgtaaactcactcagctggtgaccgagaagcacgtagaagggtgggacgatccgcgcatgctgaccgtttcaggtctgcgtcgccgtggttacaccgccgcttctatccgtgagttttgtcgtcgtattggcgtgaccaagcaggataacatcgtggagatggcctcgctggagtcctgtatccgtgatgatcttaacgagaatgcgccccgcgccatggcggttttagatccgcttaaagtggtgatcgaaaacctgccagcaggccatagcgaaatcgtcaccatgccaaatcatccgggtaaaccggagatgggcacgcgtgaagtgccgttcagccgcgagatctggatcgatcgcgcggatttccgtgaagaggcgaacaaacaatataagcgtctggtgctgggcaaagaagtccgcctgcgtaacgcctatgtgattcgtgctgagcgggtcgccaaagatgaagcgggcaacattacctgcatctactgcaccagcgatgttgatacgctgagcaaagatccagccgatggccgcaaagtcaaaggcgtgattcactgggtttctgcggatcacgcgcagccagctgagttccgtctgtatgatcgtctgttcagtgtgccaaacccggctgctgcagaggatttcctggcggtcattaatcctgaatcactgaccatcaaaaacggctttgttgaacccagcctgcgcgatgtggaaccgacaacaccgtttcagtttgaacgtgaaggttatttctgcgccgacagcgtttactcgaaaccgacgcaactggtgtttaaccgcaccgtcggtcttcgtgatacctggaccaaaacgggcgaataaattttttggggctgacctcataaaatgacaaaagggcgatttatcgcccttttttattgccccgatttttaccatcgccgacgtttattctgcactaaccacaaccggttcaataccgacttgtgggagtaatctgagtttaaaaaaattaatcaatttcaggatgtgaattgtcagctttcaggtaggctatccgctctcagaggttgcaaagcgggttacagaaggaaaaaaaatgacagttctcgcccaggaagccaaacacagtgtcgtcgttttacatcagctcattgaacgtatttttaatcagccagccggatctgacgacagtttccagctgctgatgtcctattttcatcctgaatttcgcatggtgaccccaaagggcaaagagtataatctgaacgaggtcgaggatcttttccagcagttacaagggcagcgggaagggatgcgcattgccacctgtgaacatgtcattctctctcatcatgaaaaagagatcgtcgtacagtatcgcgaaatgcagatgatgaacggcaataaccagagccgcatttcgctggccattctggattgcagcagctccattccacgctggcgctatctgcaggagacgctggtcgcctgaggtgagggcagaaaacagacgaaaaaaaaccggtgaattcaccggtttttttatttcaggccgcgccagcgttactggtcgtgcagcgtttcgtcttcacggcaatcgcccagcgtacagtgtccatagagatagaggctgtggttggtcagcttgatgccatggcgggtcgcgatttcacgctgacgtgtttcaatcgattcgtcgctgaactcgataaccttgccgcaatccaggcagatcaggtgatcgtggtgatgctgctgcgtcagttcgaagacagacttgccgccttcaaagttgtgacgagtcacaataccggcatcatcaaactggttcagaacacggtaaacggtcgccaggccaatctcttcgccaatatcgatcaggcgtttatacaaatcttccgcactgacgtgatggcactcaggtttcctgaagcacttccagaattttcagtctgggcagcgttactttcaggccagccttctttaatgcggtgttgttgtcagtcatgcggattttgtcctgttactaatattcacttttgtggcttatcgccttgaatgtcgatctgtgctcattctcatttgcgtctcattatagaactgaagcgatgaaatgaaaaccagagggcgtgtctgaatcatcatgggctattggggattcgtcaccgggccggggaagattctgacagaggtctgttagcacatcacttagtcttgccgcctgagaaaataagcggaagatcgatgcgggtattctacagattaaacggagaaagttaaaaaaatgtggctattatttctataggcattttcattgcctcaatgtgagctggcgctcacattgagtcgggcaggatcaggcttcgatgatctctttcagctgcagttcatcaaaaatctgcttaacccactggtcaacacgctggctggtcagctcaggctggcgatcttcgtcaatggccaggcccaggaagtgggtatcatcggccaggcctttcgaagcttcgaagtgatagccttcagttggccagtgtccgacaatcacggcaccgtgcggttcgataatgtcgcgaatcgtgcccatggcatcacagaaatactctgcgtaatcttcctggtcgccacagccaaacagcgcaaccagcttgccgttaaaatcgatctcttccagcgtcgggaaaaagtcatcccagtcgcactgcgcttcgccgtagtaccaggtcggaatacccagcagcaggatatcaaacgcttccagatcttcttttgtgctttttgcgatgtcatggacttctgcaacatctgtacccagctgtttctggatcatttttgcaatgttttcggtattgccggtatcgctgccgaagaagatgcctacgagtgccatgagtaaaataacctcttaaatcctgatgatgagatgtgtgccgcagcacatttcagcgaataatagcagacgagagaaaaccggtgaacggttaaagccccgacatttgctcctgcgtgcgatttgcccgcattaatccagtttgagctgtgccagtagcatctgttcaatcagttcgctacggctgagattgcgctgttctgccagcgtattgagtgcatcgacggcgtcactgttcattttcagttcgacacgacgaagcccgcgtcctttgtcacgtttcagttgattgcgcttgttaatgcgcagctgttcatcacgcgaaagcggactggttttgggtcgaccagggcggcgctcatcagcaaagagatcgagcgtcgtgcggtcagtctgttcttttgccatggcttagtaaaactgaatgggggcgggcgccagacactcaccgcgcagattataaattattggccattgccgcagcaaaactgacccgcagcaaaattttagcgcgccatcatacttcacgcttacgccggacgccaatcctaaacttttaccgccatctatttgcttttaaagcgcaaaaaagcgacggacactgcgcaaaacggcatcgggtttctctgcatgaacccagtgtcctgcgccaccgatcacatgcgcctgagcggccgggaaactgctgcagcaacgcatcgcgatagctgttatccaggtagctggagtcgccgccgcgaataaacagcgccgggtgattccaggcgggaaccggctgccagccagagatcgtggtgtagttatcccacagcaccggaacgttgaagcgccactccccctcctggaaggatttcagcaggaactggatcaccccttcttcctctatcagcgttcgcatgaccttcgccgcctcgctgcgggatgagacgcccgcatcggtgacggcacgaatgccggcaaatatctggtcatgacggcgcgtctggtaatccaccggggcgatatcgatcatcaccaggcgctcaatgcgttccggcaccagcgcgctcatggtcatggcgattttaccgcccatcgagtgtccgatcaccgcgacgcgatcaatgccatgtgcatccagtgtttcgaccatatcctgcgccattacagcgtagttcatctcgtcagatcgtggtgaaagtccgtggttgcggacatctacctgcagcaacggaccggcatctttcagcccgcgcgccagcacgccaaggttatcgagactgccaaacagaccgtgaataagcaggatgggcagagaatcagcaggggattgttcagtttgcagacgggcgttcaaaatcatagcaaagttcttaagtttgagacctgagcttaggttatcatggtttcaccttttcaggcgcgccggttccggcggcattaggacatattctgacttttgcccgtaaaccgtttgattgctaacaacccgcctgactttaactttataatcctgatgttagaacccacacaccctttgaattgcctgactatactcagagcttttcaggaaacaggtggttctgtcatgagaaagaaccgtacggaataagatgaaaacgatcgaagttgacgaagagctctaccgttatattgccagccacacgcaacacattggtgaaagcgcatccgacattctgcgtcgtatgctgaagttcacggccggtcagactgcacccgcttcgcctgcacagccagcctcaaaagatgcagcgaaagagtcccagcctgcgtctgtgggttcgcgcccgcaggatcgtgtccgcgcggtgcgcgagctgctgctttccgatgaatatgcggagcagaagcgggcggtgaatcgctttatgcttatcttgtcaacgctctatcgtcttgataccgcagcctttgctgaagctactgcatctctgcagggccgcacccgcgtctattttgcaggtgatgagcatacgctgttgcagaatggcacccatactaagccgaagcatgtgcccggcacgccgtactgggtgatcaccaacaccaatactggtcgtaaatgcagcatgatcgaacacatcatgctctcgatgcagttccctgcggaactgaccgagaaagtttgcggcaccatttaaaacttaagcgtcagggagcagcgccaatggccaatcacccacgtgccgggcaacccgcccagcagagcgatttgattaacgttgcacaattaacgtcacaatattatgtcctgcagcccgatgtggcgaacccggaacatgcggtgaaatttggcacttccggccatcgcggcagtgcagggcgtcaaagcttcaacgagatgcacattctggcgatcgctcaggcgattgccgaagagcgtaaaaagaatggtatcaccgggccttgctacgtcggtaaagacacccatgcgctgtctgaacccgccatcctgtctgtttctggaagtgctggcggcaaacggcgttgatgtgatcgtgcagcaggataatggctatacgccgacccctgcgatctcgaatgcgattcttgagcacaacaaagcgggtggcgcgctggctgacggcatcgtgattacgccgtcgcataacccaccggaagatggcggcatcaagtacaacccacctaacggcggacctgctgataccaacgtcaccaaagtggttgaagatcgtgccaatcagctgatcaaagatggcctgaaagaggtgaaacgtctgccgctggagcaggcgatggccagcggtcatgtggtcgaaaaagatctgatccagccttatgttgaaggtctggcagagattatcgacttcccggcgattcagaaagcgggcctgaagctgggtgtggatccactgggtggttccggtattgcttactggcagcgtattgctgagcactacaagctggatctgacgctggtgaatgacgcggtcgatcagaccttccgctttatgcatctggataaagatggcgtggtccgcatggactgctcgtctgaaagcgcaatggcaggcctgctggcttaccgtgacaagttcgatctggcgttcggcaacgatccagattatgaccgtcacggcattgtgaccccggcgggtctgatgaatccaaaccactatctggcggtggcgatcaactatctgttccagcaccgtccacagtggggtcaggatgttgccgtgggtaaaaccctggtctccagcgccatgattgaccgagtggtcaacgacattggtcgcaagctggtggaagtgccggtgggtttcaaatggtttgttgatggtctgtatgacggcagcctcggtttcggtggcgaagagagcgcaggcgcttcattcctgcgtttcgacggtacgccgtggtctacggacaaagatggcatcatcatgtgtctgctggccgctgaaattactgcagtgaccggtaaaaacccgcagcagcactatgacgaactggcagcgcgctttggcgcaccaagctacaaccgtctgcaggcatcagccacctcagcgcagaaagccgcgctgtcgaagctgtcaccggagatggtcagcgctgatacgctggcgggtgatcctatcaccgctcgtctgactgccgcgccaggtaatggtgcatctatcggcggtctgaaagtgatgacggagaatggctggtttgctgcccgtccttcaggcaccgaagacgcttacaaaatctactgtgaaagcttcctgggcgctgaacaccgcgcgcagattgagaaagaagccgttgagattgtcagcgaagtgctgaaaaacgcctgattagtcgggcagataaagaggcgcatcgcgcgcctcagactgctggtaaagcgcggccttcatcgctgtgaggccgtgtagctagctcaggaaacgcggccagatcggaaagacgcaaaagccgtcatccatgacacgctcggcccacgcgattacgcacctcatccctgaggtgcgcccgttgccgggccaacgcgttgcgttgttcaaaaacgctcccggcgtttttgtccctggcgtgggacgctttcctcttctggccgtgttccctgcgctttgaatttattcattgcggtgagattcacaggatttggctttatcagcactctgaaggcgcctctggcgcctttttttatggcataaagcgatagccgatcccggtttccgtcagcagatgagccggttgtgtcggattggcttccagtttctggcgcagatgtcccatatagatgcgcagatagtggctgtgctcaaccgcattgggtccccagacctggctcagcaactgccgctgcgtcagcaccttgccggcattgttaagcagaatactcaacagacgaaattcaatcggggtaaggtgaatctcactgctgccgcgctgtacccgtcgtgcggcgaaatcgacgctgacgtcggcaaacgtcactctggcatccggctgctggccactatgacgacgcagcgcaacccggacgcgcgccagcagtttcgccaatgccaaagggtttagtcagatagtcatctgcccccgcatccagtgcggcgatcttatcctgctcatcgctgcgcgctgacagcacaatcaccggtatggcgctccactgtcgcaggtcacgaatgaaatcggtgccatctccatccggcagacccagatccaggatcactaagtccggcttgcgggtcgccgcttcaatcagtccgcgttgcagtgtatcggcatcaaacaccttaagggcttcattttccagcgccagccggacaaagcgccggatctctttttcatcttcaacgatcaaaaccgtggtcacgcaatacctgccttgagtggggaccgaagcgctactttatcaacattttatgctggcgtccgtgaccataatctgtcggccctttcaacgctaacgcaaccaagcggtaacctttttgtaacttaattacaggttaattcttaaacagcaaaaatagcagcaaataagtggtcagatgagtagtaaaattacacaacctggcgtaaagttgaacacagatcacattcacactttttcacttaccgggaggagaaaccatgtatcgggcttatccacgttataaaattattgcgcgacgtacgctggtggttcttctcggcgtactggcgcttcctgttatgctgtttcgacaggatcgggcacgtttctacagctatctgcaccgcgtctggtgtaagaccagcgccaagccggtctggctggcgcaggctgaagcgagtggtagcgcgttctggtgatttcccatgccgcaaaacaggcctggtcaactgaccgggcttttttttgcgttttttctgagaataagcgatccggaatcccgttttaaccctttattcctgaccattttacgctacacttaaacctctacaagatttcggaggttgtacaagtatgagcaaaaaaatccccgttggaatcagtgcatgcctgctcggcgaccgcgtcagatttgatggtgggcataagcgtcttacttttgcgaccgacgatctcactccatttgtccgttttgagcccatctgccctgagatggcgattggtctgccaacgccgcgcccggcattgcgtctggtgaagcagggcgatgatgagctgcatctctgcttcagcaaagatggcggagaagaggttacgacgcagatgcgtgactggtctgctgagcgggtaaaatcgctgcatcacctctgtggctatatcctctgcgccaaatcacccagttgtggcatggagcgggtgcgggtctatgagcccgataacaacaataaccgcaaagcaggcaccggtatttttactgaattcctgcagcgcgagatgccctggctgccgctggaagaagatggtcgtctgcacgatcccgccctgcgtgagaactttatcggtcgtgtctgcgcgctgcatgaatttaatcagatgtgggaaagcggtctgacccggcagggactgatcgccttccacagccgttacaagctgatgatgctggcgcattcgcaggagaaataccgcgagctgggaccctttgtcgcctccatgagccagtgggagtcgctggacgcctttgcctttgaataccgcaatcgcatgatggaactgatgtcacgtcccgcctcacgtcgcaatcacaccaatgtgctgatgcatgtgcagggctacttccgcacgcatctgagttcaccgcagcgccaggagctggcaacgctgattgaccgctatcgtcagggcacacaaccgctgctggtgccgattaccattctcaaacactacatggcggagtacccgcacccgtggctggcccagcaacgctatttcgatccctatcccgaagccttgtgcttacgctacggacagtaatacaggaggagtatgaccacccatctggtctggctgcgtaacgatttacgcgtcaatgacaatctggcgctgcacgccgcctgccgcgacagcgatgcaaaagtgattgcgctctaccttgccacgccagcacagtggcagcagcatgacatgtcaccgaagcaggcgacgtttatccacgccagcctgttgcaggtgcagcgtgcgctggcagagcggggcattgaactgcactatcaggcgtgtcacgccttcagcgacagtattgatgcgctgctgcagtttctgcgctaagcagcaggtcgatcagctcttctacaattaccagtatgaagttaatgaacgccagcgcgatgcggaggctgaaaagcgtctcgacgacgcgggcgtgatttgccagggctttgatgacagcctgttgctgccgcccggcagtgtgcagagcggcgatcgctcgatgtataaggtgtttaccccgttcagcaaagcctttgtccgccgcttgcagcaggggctgcctgagtgcgtgcctgcgccgaaagcgcgcgaaggcgcaccgctgaaagcctccccgattcccgcctttgactatccaaccgaagactttgatcaggatctgtttccgccaggcgaagcggcggcgctgaagcggttgcgccatttcgccacgcaactggttctcgactatcccgctaagcgcgaccttccggcgctggacgccaccagccgtctgtcggtttatctggcgaccggcgtactgtcgccacgtcagtgcctgcatcgcgtgctgcatgaacatcccgatgcgctggacaacagccgcgcgttcacctggctgaacgagctgatctggcgtgaattctaccgtcatctgctggttgcctggccggcgctgtgccgacacaagccgtttatcgactggacgcgtaatgttgaatggcagcgtaacgacgcacatttcgacgcctggaaagcgggtaaaaccggctatccgattgtcgatgccgcaatgcgtcagatgaaggcgctgggctggatgcacaaccgcttacggatgatcaccgccagtttcctggtcaaagatctgctgatcgactggcgtgaaggtgaacgctatttcatgcagcagctgattgatggtgacctggccgcgaacaacggcggctggcagtgggcggcctcgaccggcaccgacgcggcgccctatttccgcatctttaacccgaccacgcagggcgagcgcttcgatgagaagggggattttatccgtcactatctgcctgaactggccggggtccctgacagtgatattcaccagccccatgtctgggcggagaagcatcataagaaactcgattatccggcaccaatcgtggatcataaggtggcacgtaaaaagacattagacgcctttgagcgcgccaagagcgcagcctgaggcctcgaaggagcctgaatgaaccattacgaattagagacgctgatcaatcagcaactcgatagccacagtttcagcgattacgcccccaacggtttgcaggttgagggacgcagcgagatcaaaacgattatcaccggcgtcactgcctgtcaggcgctgctggatgaggcggtggcgcgtcaggccgatgcgattattgtccatcatggctatttctggaaaagtgaaccggccgcgattaaaggtatgaagcgccgtcgtctgcggaccctgctggccaacgatatcaatctctatggctggcacctgccgctcgacgcgcatcctgaactaggcaacaacgcccagctggcgaaactgctggatatcgaagtgcgcggcgaagtgatgccgctggtattctggggtgagctggctgagcccctgtccggcgaaacagctggcccgccgaattggtgagcggctgggacgtgaaccgctgcattgtggtgacaacgcgccagcgctgatccgtcgcattgcctggtgcagcgggggcggacagggctttatcgaccaggcggcggcggcgggcgtcgatgcctttatcactggtgaagtctctgaacagactattcacagcgcgcgtgagcaggggctgcatttctttgccgcaggccatcacgccaccgagcgcggcggcgtaaaagcgctgggcgactggctggcgcaacaccacgatcttgatgtgaccttcatcgatatccccaatcctgcctgactctctcccttgtcctgcgcgcctgcgcaggacctaaatctgttgacacatccctgtcactttcgcataactgtttgctttacgtagataagcaatgggctgcaccgggcatccggtcaggtcggccaggcgcgatctcaactgagcgggaggtagctgttgcaacgagcacggtgttatttattgggtgaacgcgctgtcgtgctggagctggaaccgccggtatcactggagagccagcaacgaatctggggactgaatcagcgcctgcacgactatgccagcgtgctggaggtgatccccggcatgaacaacatcaccctgatcctgcgagatccccagcagagcgcgctggacgcaatagagcggcttcagcgctggtgggaagagagtgaagcgcagttgccggagtcgcgtcaggtggagatcccggtgatctatggcggcgagtctggccccgatctgacggtggtggcggaacacgccgcgctgacgccccgtcaggtggttgagctgcacagcagcagcgactatgtggtcttttttatcggctttcagcccggttttccctatctgggcggactggatcagcgcctgcacattccgcggcgtgctgagcccagggttgcagtgcccgccggctcggtgggcatcggcggcagccagaccggcgtctatccgctggcttcgcccggcggctggcagttgattggccagacgcgcaccgcgctgtttgatcccctgcagcaaccgcccacgctgctccgtcccggtgacagggttcgctttgtgccgcaacaggagggcgtatgttaaacattctgcgagccggcctggccgcgactattcaggatgcgggccgttacggctggcgtcagtatggcatcagccctggcggtgtgctggatcatcccgcgatgttcaccgccaatgtgctggtgggcaatgatcccgacagcgcggtactggagatggtgctcggccagttcaaagcggagtttacccgcgatggctggtttgcgctgaccggcgcaggctgccatgcggagcttgacggccagccggtctggacgggctggcgtaccccggtgaaacgggggcagctcctgtcactggcgatgccgcagcgcggcatgcgcagctatctggcagtgcagggcggttttgatatccccgcgatgctcggctctgccagcaccgatctaaaagcaaaatttggcggattccaggggcgaaccttgcaggatggcgatcagctcccgctgggtaaaccgacccgcacgtttgaccgtaaagtcggggtgcggcaactgctatggggcaaccgcatccgcgcactacctggcccggagtatcacgagttcagccgcgaagcgcagcaggcgttctggcgtaccgcatggaaactcagcccgcaaagtaaccggatgggataccggcttgagggacgcaagcttgagcgcgagagcccgcgcgagttgctgtcacacggcgtgatgccgggtgtgattcaggtgccgccgaacggacagcctatcgtgctgatggcggatgcccagaccaccggcggctatccgcgcatcgcctcggttatcgaagccgatctctatcacctggcacaaatccggctgggtgagccgattcattttattcactgcaccctgccggaagcgatgctggcacgtcagcatcagcaacgcgcactggaccagatgaagtggggactccatgaaaattgatttaaacgccgacctgggcgagggctgcgccagcgatcaggcgctgctgcaactggtgagttccgccaacatcgcctgtggctttcacgcaggtgatgcgcagaccatgctgcagtcggtgcgctgggcacaggcatctggcgtcgcgattggtgcacatcccgcttttcccgatcgggaaaactttggccgcagcgccatgcagctgccgccggaaacggtctacgcccagatgatctaccagattggtgcgctgaaaagtctggcggaaagcgaaggagcgcggctgcttcatgttaaaccgcatggcatgctctacaaccaggctgcggccgatccggtgctggcggacgccattgcccgcgccatcagggctgtcgacagccagctgattgtggtgggactggctaacagcgaatcgattcgcgcggcggcgcactacggcctacgcacgcgggaagaggtgttcgccgaccgtggctatctcagtagcggtgcgctggtgccgcgcagcgagccgggcgcgctgattgaagatgaacagctggctatcagtcagacgctgacgatggtgcagcagggcaaagtcaaaagtatcaccggagaatgggtagcggtgaatgcacagaccgtctgcttacatggcgacggcgcgcacgccctgcaatttgcacagcggttgcgtgatgcgtttgccgatcagcagattcgtgtcaccagcaactgaataaccacacttagcccggcgtatgccgggtttttcaactctgagggaaatccatggatagtgcagtaaatctctggccattactgggcatcgccgccatcgtcgtcggcttcctgttacggttcaatccggtgctggtggtgattgtcgccgggtttgtgaccggtctggccgcgatgatgccgctggcggacattctggaaaagctcggagcgggttttcttaacacccgcaacctgccgctgatcctgctgctgccgctggcggtcattggcctgctggagcgtcacggactgaaagagcgggcgcaggcgtggattgcacagatcaaaacggcaaccgccggacggctgctgatcgtctacctgtttgtgcgcgaaatcaccgccgcgctggggttaaccagtctcggcggacatccgcagatggtgcgtccgttgctggcaccgatggcggaaggagcaactgaaagccgctatggcgagatctcacctgagctgcgccatcggctgcgcgcgatgtcagcggcgaccgataatgtcggcctcttctttggtgaggatatcttcgtggcgtttggcgcgattatctttatgcacaactttatgcaggagtcagccgggattcagaccgaaccgctgcacatcgccttatggggcattccgactgccgtcgccgcgttcttgatccactcggcacgtctggtgcggctggatcggcaactggcgcgagagctgcagcagttgaaccgtcaggcgctgaaagccaaaggaggtgagtaatgttccagcaacaatatctgatgtggctggcgggcattatcctgctggtggtggcggtgctttcctggcgtgacagcgcgaatccgcgtcgttttaccaccggactgttctgggctttgtatggcctggtttttctggtcggtgactggacgacgcaactgatgagcgcctggatggggtcagatgcggcgggcacccgtatgctgcacatcggcatcggtgtcattgtggtggtgatggcgctgattgccgggtttggcggtgtcaggctgggtcgctatcatcagcgtagcgatgaagagaaacaggccagtgcgctgcgtctgcgcaataaactgtttctgcctgcactgtcgattccggtcgtgaccgtggtcggtgtgctggcgtttaaccatattcccggtttgcaggatgcggtgttcggccccggtaaccacgccacgctggtgacgctgttttcaatgatggtcggctgtgtgattggctggctggtggcgttaaaactgacccacgagaaaccggtgcagtcgatgcaggagacccgtcgcctgctggattcgattggctgggcctttatcctgccgcagatccttgccaccctggggctgctgtttaccagcgcaggcgtgggcagtgcgatttcgcatctgacagaaacctggctggcggtagataatcgctttgtcgcggtcaccgtctatgccgtcgggatggcgctgttaaccatgatcatgggtaatgcttttgcggcgtttccgataatcaccgcaggcgtcggcatcccgattcttgtgttgcagcacggcggaaatccggcagtgatggcggcaattggcatgtttctccggctattgcggcacgctgatgacgccgatggcggccaacttcaatatcgtcccggcagcgctgctggaactgcccgatcgtaacgcggtgatcaaggctcagattccgaccggtgtgctactgttaatcgttaatattttcctgctctatttcctgatgttcctgtgaggttgcatgaaaactgtcctgatgaccgcctttgaaccttttggcggtgaaacgattaacccttcatgggaagcggtgcgcgcgctggaaggtaaacagattagcggggcgacgatagttatacgccagttgccggtggtattcagcgacgtactcagggtgctgaatcaggcgctggaagaggtgaaaccggatgcgattctgtcggtggggcaggcgggcggccgtagcgacattaccgttgaacgtattggtattaatgtcgatgacgcccgtatcccggacaacgccggtcatcagccggtggatgagcccgtcgtagcaggtggcccggcagcctatttttcccgtcttcccatcaaagcgattgtggcggcggtgcgggaagcggggatccccgcttcagtgtcgcaaacggcgggcacctttacctgtaaccgcgtaatgtacggcctgctgcactggcttgagcagcatgacagtccggtgcggggaggttttatccatattccttatctgccagaacaggcggcgcagcatccgggcgcaccgagcatggcgctggcgtccattattcaggcgctggaaattgcggtaaaggtcacgctggagaccggcgaggatatcagacaggctggcggcgccacccattaagaggatgaacgatgcctgaaggaccggaaattcgtcgcgtggcggataaacttgaagacgccattgtgggtcagccgttaacggaagcgtggttcgcgtttcctcagctcaagacctatgaaccggcgttgattggtgagcaggttcaggcgattgagacgcggggcaaagcgctgctgactcatttcagcaatggcctgacgctctacagccataaccagctttatggtgtctggcgcattgtaaaacctgacaccgaactgaattccacccgtcagttgcgggtgcgactggcgacggcgggcaaagcgattctgctctacagcgcctcagatattgagctgctcaacgcagatacgctggcggcgcatccgtttcttaatcgtatagggccggatgtgctgaacagtgccctgacagtggaagaggtgaaagagcgactgctgtcaccccgtttcaggcggcggcagttcagtggtctgttgctggatcaggcttttctggccgggctgggaaactatctgcgcgccgaaattctgtggctggcgcagctgctgccaaatcatcgggcgcaggatctcagtaacgatcagctgactgctttcagcgaagcgctgctttcagtgccgcgccatgcctatcggatgcgtggaaccatgaagaaatatcatgaggaagcggcgtttcagtttgaggtttttcatcggcagggcaaaaaatgccgacgctgcggcacggtgattgagaagggcacgctctcatcacggcctttttactggtgtccgggttgtcagagataggcacttgaagaaagcaaaagcggggtagtgtagttttctggtctgcggtgagatcgagcctgctcaggaaacacggtcagatcggaaagacgcaaaagccgtcatccctgacctgctcggcccgcgcgattacgcacctcatccgtgaggtgcgcccgtagccgggctaacgctttgcgttattcaaaaacgctcccggcgtttttgtccatggcgcgggacgctttcctcttctgaccgtgttccctgcgcgttaaacttcttcattgctgccagatgcgcccttatgtgggcttctcaactggctgagcggagatccctctccgctatccactgagccttactttttcagctgtgagctgaattcgcgctcggtataaccggtgtagagctgacgtggacgggcaatcttcatgccttcgtcgtgcatctctttccagtgtgcaatccagccaacggtacgggccatcgcgaagatcaccgtaaacatggaggatggaatacccatcgctttcagaatgataccagagtagaagtccacgtttggatagagtttacgctcaatgaagtacgggtcgttcagcgcaatgtgttccagctccatcgccacttccagcaggtcatccttcatacccagctcattcaggacttcatggcaggtatcgcgcatcacggtcgcgcgtggatcgtagtttttgtaaacgcggtgaccaaagcccatcagacggaaggagtcatttttgtctttggcgcgtttaacaaattccggaatatgctcaacggtgctgatctcttccagcatacgcagggtcgcttcgttggcaccaccgtgcgccggtccccacagggaggcgatcccggcggcgatacaggcaaacggattcgcgccgcttgaaccggcggtacgaacggtagaggttgaggcgttctgctcatggtcagcatgcaggatcaggatgcggtccatggcgcgttccagcaccggattcactttgtactcttcgcacggcgtggcaaacatcatgtgcaggaagttacccgcataggagagatcgttgcgcggatagacaaacggctggccgatagaatatttgtaacacatcgctgccatggtcggcattttagaaagcagacggaatgctgcgatttcgcggtggcgctcaatgtttacatccagcgaatcgtggtaaaacgcagccagtgcaccagtaacaccgcacattaccgccatcggatgcgaatcgcgacggaagccgtggaacaggcgggtaatctgctcatgaatcatggtgtggcgggtaaccgtggtacggaactcatcaaactgtttctggtttggtgcttcgccgttcagcaggatatagcagacttccagatagttagagtgggtcgccagctcagaaatagggaaaccacggtgcagcaggataccttcatccccatcgataaaggtgattgcagattcgcaggacgcggtagacgtaaaaccgggatcgaaggtgaacaggccacttgaacccagagtgcggacatcaacgacatcctggcccagcgtacctttcagcacgtccagttcaatagatgttccatcttgcagggttagcgttacttttttatctgtcattttcgtctccatagcgccttatgtaggtaaggatctttagacacctgaaacgcgttcatgttgcggttggcaaaactacacagtatcactctgcggggataaaacgggtgcagggtacagagtgagcggcgcgtttcccagcgggaaccggtgagccatggacatgctgcatatcgcggttgttaaagatccggtcaggacataacttcttggtaaccaataacctgatgctttttaatgctcattatcgcaatgttacataacttgcgcttaggggaaagtgtatccccataacttttgcgcatcataggaatttacaggcttagtttgtaactgaattgttgaactattgtcaaatcagataattaaaattgtatcaattgtgaaaatcgtgagtaggatcactgttccacctaaaatataccaaagagtttgtaggggaattgtaatcagaatgtgatcctcctatactccaggcaggtctccggaacaccctgacaccaggagccacccagcgtttactaccgcgtcaattaacactggatgttgcttttttggtgacggttaaagtctgccacgcgttgtgattagactccgcctcaggtccggaggaagcaaaataaaaaagagctgtgtgggcaaaaccgtgaaaaaacaaagacctgtcaacttggatctctcgacgatccggtttcccgttactgcaatatcgtccattcttcaccgcgtctccggcgtaatcacattggttgccattggcatcctgctgtggctgctcggtctctctctctcctctcctgaaggtttccagcacgctgcgtccatcatggatggcttcttcgcgaagttcattatgtggggcatcttaacggcgctggcctatcacgcggtgagcgggattcgtcatatgttgatggattttggttatctggccgaaacgctgcaggttggtaagcgttccgctcatatgacttttgtgatcactgtcgtgctggcaattctggcgggagtcctcgtatggtaagcaatgcatccgcattgggtcgcaacggaattcaggactggctgctgctgcgggcaactgcaattctcataacgctctacatcgtctatatcctcggtttcgtggtgatgacagacacgctgacttatgacctgtggcgtggcttcttcgcttccgcattcaccaaagtgttcacgctgctgacgctgtttctccattctgatccacggctggattggcatgtggcaggtgttaacagactacgttaaatcactgccaacccgcttgttgttgcagtttgtgattgtcgtggcgctgttgtggtatgcgatttatggatttgttgtggtgtggggtgtgtaaatgagtttgccaatcagagagttcgatgccgtggtaatcggcgcaggtggcgcaggaatgcgagccgcactgcaaatctcccagggcggccagagctgtgccctgttatctaaagttttcccgacccgttcccacaccgtatctgcgcagggcggtattaccgttgcgctgggtaatacccatgaagataactgggaatggcacatgtacgacaccgtcaaaggttccgactatatcggtgaccaggacgcgattgaatatatgtgtaaaaccggcccggaagcgattctggaactggaacacatgggtctgcctttctcgcgtctggaagatggtcgagtctaccagcgtccgtttggtggccagtcaaagaatttcggtggcgagcaggcggcacgaacggcggctgcggctgaccgtaccggtcacgcattgctgcacaccctttatcagcagaatttgaaaaacaaaaccactatcttctctgagtggtatgcactggatctggtgaaaaacgccgatggcgcagtcgtgggttgtaccgctatctgcatcgaaaccggcgaaaccgtttatttcaaagcgaaagcgaccattctggccaccggcggcgcgggccgtatctatcagtccaccaccaatgcacacatcaacaccggtgacggcgtaggtatggcactgcgtgcgggcgtaccggtgcaggatatggagatgtggcagttccacccaaccggtatcgccggtgcgggcgtgctggtcaccgaaggctgccgtggtgaaggcggctatctgctgaacaaacatggcgaacgcttcatggagcgttatgcgccgaacgccaaagatctggcgggccgcgacgtggttgcgcgctcaatgatgattgaaatccgtgaaggtcgcggctgtgatggcccgtggggtccacatctcaaactgaaactggatcatctgggtaaagaggtgcttgagtcacgtctgcctggcatccttgagctgtcacgcacctttgcgcacgccgatccgattaaagagccgattccggtcattccgacctgccactacatgatgggcggtattccgaccaaagtgaccggccaggccctgcgcgtcaatgagcagggcgaagatgtagtgattccaggcctgttcgccgtcggtgaaatcgcctgcgtatcggtacatggtgccaaccgtctgggcggtaactcactgctcgacctggtggtctttggccgtgcagcgggtctgcatctgctggcgagtattcaggagcagggcgacctgcgtgatgccacagaagatgagatcgccggggcgatggcgcgtttcaaccgctgggaaaataacaccacgggtgaagatccggttgagattcgtaaagcgctgcaacgctgcatgcagaataacttctcggtattccgtgaaggcgaagcgatggcacagggtctggaagagctgaaagagattcgccagcgtctgaagtcagcgcgtctggatgaccgctcaccggatttcaacacccagcgtattgagtgcctggagctggataacctgatggagacggcctttgccacggcggtagcggctaactatcgcaccgaaagccgcggtgcgcacagtcgcttcgacttcccggatcgtgatgatgaaaactggctgtgccacagtctttatgtcccggaaaccgaaagcatgacgcgccgtgaggtgaacatgcagccgaaactgcgcgcggccttcccgccgaaagtgcgtacctactaatttcggagacgatcatgagactcgagttttcaatttatcgctacaatccggatgtcgatgacaaaccgcgcatgcaggattacaccctggaagcggaagatggtcgcgacatgatgctgctggacgcgctgattcgcctgaaagagaaagatccgaccctggcgtttcgtcgctcctgtcgtgaaggcgtctgcggttccgatggcctgaacatgaacggtaaaaacggactggcctgcattacgcccgtctcggcgctgggcaacggcaaacagaaaattgttatccgtccgctgccaggtttaccggtggtgcgtgacctggttgtagacatgagccagttttatgcacagtatgagaaaattaagcctttcctgttgaataatggggaaaatccgccagctcgtgaacatctgcagtcgccggatgagcgtgaacacctggatggcctgtacgaatgtatactctgtgcctgctgctcaacctcatgcccatcattctggtggaatcctgagaagttcatcggtcctgctggcctgctggccgcgtaccgcttcctgattgacagccgcgacaccgaaaccgaggcgcgtctcgacaatctgaatgatgctttcagcgtattccgctgccatagcatcatgaactgtgtgagcgtatgtccgaaagggctgaacccgacgcgcgccatcggccatatcaagtcgatgctgctgcagcgcggcgcataagcagtttctgccgggaacctcaggtttcccggtgttttacggaagcctctgtaagcgcggtgattaccacgtttacaaaggttcccttacgggccacgcgcgctgcgcaaagtgctcgtatcgctgaactcactacggcaaaccgcgaaagcggcaacaaatgaaacctcaaaaaagcatagcaatgcttaagggatcacaatgcagaacagcgcgatgaagccctggctggactcttcctggctggccggcgcgaatcagtcttacatagagcagctctatgaggatttcctgaccgatcctgactctgtcgatgcagtgtggcgctcgatgttccagcagttaccgggcaccggaatgaaacctgagcagtttcactccaccacacgtgagtacttccgtcgcctggcgaaagacgcatctcgttacacctcatctgtctccgatcctgaaaccaactccaagcaagtaaaagtgctgcagctgattaacgcgtttcgtttccgcggtcatcagcacgccaatcttgacccgcttggtctgtggaaacaggaccgggtagccgatctcgatcccgcttttcacgatctgaccgaggccgattttcaggaaagctttaacgtcggctcttttgccattggcaaagagaccatgaagctggccgaactgttcgaggcgctgactcagacttattgcggctcgatcggtgcagaatatatgcacatcaacaacactgatgagaaacgctggattcagcagcgtcttgagtcagtcgcgggccgtgcagccttcagcaatgaagagaaaaaaggtttcctgaaagagctgaccgcggccgaagggctggaaaaatatctcggagcgaaattcccgggtgccaaacgcttctcgctggaaggcggcgatgcactggttccgatgctgcgcgaaatgatccgtcatgccggtaagagcggaacccgtgaagtcgtattgggtatggcacaccgtggccgtctcaacgtgctgatcaacgtgctgggtaaaaagccacaggatctgttcgacgagttcgccggtaagcacaaagagcatctgggcaccggtgacgtgaagtaccacatgggcttctcgtctgacgtggaaaccgaaggcggcctggttcacctggcgctggcgtttaacccgtcgcacctggagatcgtcagcccggtggtcatgggttcagtgcgtgcccgtctggatcgtctggatgagccagccagcaataaagtcttaccgatcaccattcatggtgatgcggccgtgattggccagggcgtggttcaggaaactctgaacatgtctcaggcgcgcggttatgaagtgggcggtaccgttcgcatcgtcatcaacaaccaggttggctttaccacctccaacccgaaagatgcgcgttcgaccccttactgcaccgatatcggcaaaatggtgctggcaccgattttccacgtcaatgctgacgatccggaagcggtcgcgtttgtgacccgtctggcgctcgactatcgcaacacctttaagcgtgatgtgtttatcgatctggtctgctatcgccgtcatggtcacaacgaggcggatgagccaagtgcgacccagccgctgatgtaccagaaaatcaaaaaacacccgacgccgcgtaaaatctatgccgaccgtctggaaggtgaggccattgccacgcaggaagatgcgaccgaaatggtcaatctctaccgtgacgcgctggatgcgggtgagtgcgtggtgccggaatggcgtccaatgagcctgcactcctttacctggtcaccttacctgaaccatgagtgggatgaaccttacccggctcaggtcgacatgaaacgtctgaaggagctggcgctgcgtatcagccaggtgcctgaagaggtggaagtgcagtcgcgtgttgccaagatttacaacgaccgtcgtctgatggctgaaggcgagaaagcctttgactggggcggcgcggaaaacctggcatacgccacgctggttgatgaaggcattccggtgcgtctgtcgggtgaagataccggtcgcgggaccttcttccatcgtcacgcggtagtgcataaccaggcgaaacggctcaacctatacccctctgcaccacgtgcacagcggtcagggccagttcaaagtctgggactccgtgctgtcagaagaggcggttctggcctttgaatatggttatgccaccgcagagccgcgcatcctgaccatctgggaagcgcagtttggtgacttcgccaacggggcacaggttgttatcgaccagttcatcagctccggtgagcagaaatggggccggatgtgtggcctggtgatgctgctgccgcacggttatgaaggtcaggggccagagcactcctctgcgcgcctggaacgttatctgcaactctgcgctgagcagaacatgcaggtctgcgtgccgtctacccctgcgcaggtttaccatatgctgcgtcgtcaggcgttgcgcggtatgcgccgtccgctgattgtgatgtcgccgaaatcactgctgcgtcatccgctggcgatctccacgctggatgaactggctaacggcagcttccagcctgcgattggcgaagtcgatgatctggatccgcagggcgtgaaacgcgtcgtgctgtgctccggtaaagtctattacgacctgctggagcagcgtcgtaaaaatgagcagaccgatgtggctatcgtgcgcatcgagcagctctatccgttcccgcatcacgcggtacaggaagcattaaaagcgtatgctcacgtgcaggattttgtctggtgtcaggaagagccactgaatcagggcgcctggtattgcagccagcatcatttccgtgaagttgtgccgtttggtgccactttacgttatgcaggccgcccggcatccgcctcaccggccgtgggttacatgtccgtacaccaacaacagcagcaagacctggttaatgacgcgctgaacgttaattaattaaaaggaaagataatgagtagcgtagatattctcgttcccgacctgcctgaatcggttgccgatgcctctgtggcaacctggcataaaaaaccaggcgatgcagtcactcgcgatgaagtgctggtcgaaatcgaaactgacaaagttgtactggaagtgccagcctctgcggacggtatcctggaagccgttctggaagaagagggcgccaccgtcacttcccgccagatcctgggtcgtctgaaagagggcaacagcgccggtaaagagagcagcgcgaagtctgaaagcaaagagtctaccccggctcagcgtcagactgcgtcactggaagaagagagcaacgatgcgctcagcccggcgatccgccgtctgattgcagagcacaatcttgatgcctcacagatcaaaggcagcggtgttggcggtcgtctgacccgtgaagatgttgaaaaacatctggccaacaaaccgcaggctgccaaagccgctgcaccagctgctgatgcggccgccgcgcagcagccagtggctaaccgcagcgaaaaacgcgtgccgatgacccgtctgcgtaagcgtgttgcagagcgtctgctggaagcgaagaaacagcaccgcgatgctgaccaccttcaacgaaatcaacatgaagcccatcatggatctgcgtaagcagtatggtgaggccttcgagaagcgtcacggtgtacgtctgggctttatgtccttctacatcaaagcggttgttgaagcgctgaaacgctatccggaagtgaatgcttctatcgatggtgaagatgtggtttaccacaactacttcgacgtcagcattgcggtctctacgccacgtggtctggttacacccgtcctgcgtgacgtggatgcgctgagcatggcggacatcgagaagaaaatcaaagagctggcagtgaaaggccgtgacggcaagctgacagttgaggatctgaccggcggtaactttaccattaccaacggcggcgtctttggttcactgatgtccaccccgatcatcaacccaccgcagagcgccatcctgggcatgcacgccatcaaagatcgtccgatggcggtcaatggtcaggttgtggtgctgccaatgatgtatctggcgctctcctacgaccaccgtctgatcgatggccgtgaatcagttggttatctggttgcagtgaaagagatgctggaagatccggcgcgcctgctgctggatgtctgattttcaccgggcgcgccttgccgcgcgcccaacctcattactcttttcagacctgaatggatagaacatcatgaacttacacgaataccaggcgaaacaactgtttgcacggtatggcatgccggcaccaacgggttacgcctgtactacaccacgtgaagcggaagaagcggcctctaaaattggcgcaggcccgtgggtagttaaatgtcaggttcatgccggtggccgcggtaaagcgggcggtgtgaaagtggttaacagcaaagaagagattcgcgcttttgctgaaaactggctgggcaaacgcctggttacctatcagacagacgcaaacggccagccggtaaaccagattctggttgaagcggcgaccgatatcgatcaggagctctatctgggcgctgtggtcgatcgcgcaacgcgtcgcgtaattttcatggcctccactgaaggcggtgtggaaattgaaaaagtggcggaagagaccccgcacctgatccacaaaatggcgctggatccactgactggcccgcagccttatcagggccgtgagctggcgttcaaacttggcctgaccggcaagctggttggccagttcaccaagatcttcatgggtctggcgacactgttcctggagcgcgatctggcgatggttgagatcaacccgctggtgatcaccaaacagggcgacctgatctgcctggatggcaaactgggtgccgatggcaatgccctgttccgtcagccagagctgcgcgaaatgcgcgatccaagccaggaagatccgcgtgaagcccatgcgacacagtgggaactgaactatgttgcgctggaaggcaacatcggttgtatggttaacggcgcaggtctggcgatgggcaccatggacatcgttaaacaccacggcggtcaaccggccaacttccttgatgtcggcggcggcgcaaccaaagagcgcgtgaccgaagccttcaaaatcatcctgtctgacgatgcggttaaagccgtattcgttaacatcttcggcggtatcgtacgctgcgacctgattgccgacggcatcatcggcgcagtcgctgaagtgggtgtgaacgtaccagttgtggtacgtctggaaggtaacaacgccgagctgggcgcccagaaactggcggacagcggtctgaacatcattgcagcaaccagcctgacagacgccgcacagcgtgttgttgctgccgcggagggtaaataatgtccattctgatcgacaaaaacaccaaagtcatttgccagggtttcaccggtggccaggggactttccattctgagcaggcgctggcatacggcacccaactggttggcggcgtgacgccaggcaaaggtggcacgacccatctcggcctgccggtgttcaacaccgttcgcgaagcggtagaagcaaccggcgcgaccgccaccgtgatctacgtttccggctcctttctgtaaagatggcatcctggaagcgatcgacgcgggcatcaaactgatcatcaccatcaccgaaggcatcccgaccctggatatgctgaccgtgaaagtgaagctggatgaagcaggcgtgcggatgatcggtccaaactgcccaggcgttatcaccccaggcgaatgtaaaattggcatcatgccgggccacattcaccagccgggccgcgtcggtatcgtgtcacgttcaggcaccctgacctatgaagcggttaagcagaccacggatatcggctacggccagtcaacctgcgttggcatcggtggtgacccgatcccaggctctaacttcatcgacatcctgaaaatgttccaggatgatccacagactgaagttatcgtgatgatcggtgagatcggcggtagcgcagaagaagaagctgcagccttcattaaagagcacgtgaccaagccggttgtaggctacattgctggcgtcaccgcgccaaaaggcaagcgtatgggccatgctggcgccatcattgccggtggtaaaggtacagcagatgagaaatttgctgcgctggaagcggcaggcgtgaaaaccgtccgcagcctggcggatatcggtgacgcagttaaagccgtattaccggctaaataagtcagcgtcatctgagactaagccaccttcgggtggctttttttatgcctgtaaatgagagctataacgcaggaagctaaagagaagagtgcgcggtaaaatagctggcccgcggctcattacgttaagaaaaagtgtcaaaggtaaattattccttcgcgctttatttcattactgacatctcattaacaagaaacctacctgactctatctggaaacttattgcgttaatccagatcaattaatcgcgacttatatccaactatatctctggcaaagcgcaacgctaagggcgtaaattgcgctgcatcaatccagccttttacacaaattttcaaacgtctgctcaacccgggataacacccgctttcctcctgttaaagcacgcgttaacgaaagcgctgattgacaattttctgagctgcttcattcgctactcgcctgttcgggcagctcacagacctgttctgcgggtaataaaaaactggaatcaataaacagtcgttgctgactctgattgcgttcgatctgatcgcgcgcgtgacggagacaaagcgaggagcaaggagtccttatgttagatatcgtcgagctgtcgcggttacagtttgccttaacggcgatgtaccattttctgttcgtccctttaacgctgggtatggcgtttttgctggcgatcatggaaacggtatatgtcctgagcggcaaacaaatctataaagatatgacgaagttctggggcaagttatttggtattaactttgcgctgggtgtcgccaccggcctgaccatggaatttcagttcgggactaactggtcatattactctcactacgtcggcgatatcttcggcgcgccgctcgccattgaaggtctgatggcgttcttcctggaatccacctttgttggcctgttcttttttggctgggatcgcctgggcaaagtgcagcacctcgccgtcacctggctggtggcgctgggctcaaacatgtcggcgctgtggattctggtggctaacggctggatgcagaatccgatcgcctctgagttcaacttcgaaaccatgcgcatggagatggtcagcttctcagagctggtgctgaaccctgtcgcgcaggtgaaattcgttcacaccgtagcagccggttacaccaccggagcgatgtttattatgggcatcagcgcctggtacatgctgaaaggccgtgacttcgcctttgctaaacgctcgttcgctatcgcggccagctttggcatggcggcggtgctgtcagtcatcgttcttggcgatgagtcaggttacgaaatgggtgacgtgcagaaaaccaaactggccgctatcgaagcggagtgggaaacccagccggcaccggcctcgtttaccctgtttggcctgcccgatcaggccactcaggagaaccgatacgcagtacagatcccctggctgctgggcctgatcgccacccgatctaccgatacgccggtaaccggcctgaaagatctgatggcacagcatgaagtgcgcatccgcaacggcatgaaagcctatgccctgctgaatgagctgcgcggtggcagccaggatccggcggtgcgtgacgcgttcaacagccacaaacaggatctcggctacggtctgctactgaagcgttataccgacaacgtggctgatgcgaccgaagcgcagattaaacaggcgacgcaggactctatcccgcgtgtcgccccgctctatttcgccttccgcatcatggtgctgtgtggcgtactgctgctgggcattatcgcgctggcattctggagcgtactgcgtaaccgtatcggtaaaaatcgctggttactgaaagcggcgctgtttggtattccgctgccgtggatcgctatcgaatcaggctggtttgtggcggagtatggtcgtcagccctgggctatcggtgaagttctgccgactgcggtagccaactcctccctgaccgttggcgatctgctgttctccatgatcctgatctgcggactctacacaatgttcctggtggctgagatgtacctgatgttcaaattcgcccgccttgggccgagcagcctgaaaaccgggcgttatcatcatgagcagatcacggcaatcacccagccggtacagggataaggagagcgaccatgtttgattatgaagttctgcgctttgtctggtggctgttgattggcgtactgctgattggctttgccgtcgcagatggttttgatatgggtgtcgggatgctgacgcgcattctgggccggaatgatactgaacgtcgcatcatgattaacagtatcgcaccacactgggacggtaaccaggtctggctgatcaccgcaggtggcgcgctgtttgccgcctggccgatggtttacgcggcagccttctctggcttctacgtagcgatgattctggtgctcgcgtcgctgttcttccgtccggttggcttcgattaccgttcgaagattgaagacaatcgctggcgcggtgcctgggactgggggatttttattggcagcttcgtgccgccgctggtgattggcgtagcgtttggcaacctgttacagggcgtgccgttccatgccgatgagtatctgcgcctgttctataccggtaacttcttccagctgctgaatccgtttgggctgctggcgggtatggtcagtgtggcgatgattctggcgcagggtgcaacctatctgcagatgcgcactaccggcgaactgcatctgcgttcacgcaccgcagcacaacttgccgccctggtgatgatgatctgctttatcctggcgggcgtctgggtgaaatatggtatcgatggttatgtggtgaccagcaccatggatcacttcgctgcttctaacccactgggcaaaaccgtagtgcgcgaagcgggtgcctggatggtcaacttccagaaccaccctgtgctgtggctgttcccgctgctgggcgctgtgctgccgctgctgaccatactctgctcgcgggttgagaagggcgcctgggcgttcctgtttctcctcactgacgctggcctgcgtcatcatgacagccggcattgcaatgttcccgttcatcatgccatccagcacggtgccgggtgtgagcctgaccatgtgggacgcaacgtccagcctgctgacgctgcaaaccatgaccgttgccgccgctatctttgtgccgatcattctggcctacaccacctggtgctactggaaaatgtttggtcgtatcaccaaagagcatattgaaagcaacagtcactcactctattaattaaggagacgtcgcatgtggtattttgcctggattctcggcacgttgctggcctgtgcctttggtatcgtgaccgcgctggcgattgagcacattgaagcgcaggatgagcctcactgatgcgaacgctaattcggatgctgtatgatctgatggataagggcccgttacgggccctttcactgctgctggcgctgctgaccgcaggcggcgtgatgtgggatccgacacgctttgccagtcaggcaggccagttaccggctctgcaggggctggtgctgatctgggcggtctgcagtggggtgatccacggtgtgggcttccggccacagcaaacccgatggcaggcgctgtttgccccgttacccgccatgctggtgctatttattgcgctttaccgtttttatctttaagaccccttctcatcggcgctgtcagtgaatttttgtcagcgtctggtcaattaatctccctgaaatcgttccgtttgttacggagcgataattattttcgcctggctctgacgagccattcccaaccccaattctcttgcgtatagtaacaacgtttaaaacgaggccgggatgtagagtgagtacaacgctgtttcgctggccggttcgggtctactacgaagatactgatgccggtggtgtggtttatcacgccagctatatcgctttttatgaacgagcacgtactgaaatgttgcgacagcaccatttcaatcagcagacgctgttagaacagcagatcgcttttgtggtacggcgtatatcggtggactatctggcggcggcgcgtcttgatgaccttctggagatccagagcgaggtcacatcaatgacacgggctaccatgacgttcactcagcgtatcgtgaatactgaaggcaaagtgctcaatgaggcagaagtcctgattgcctgcattaacccacatctaatgaagccgattgcgcttcccaagtctattgtcgcggagttcaagcagtgactgacatgaacattcttgatttgttcctgaaggcgagccttctggtcaaacttatcatgttgattttgatcggcttttctattgcctcctgggccatcattattcagcgcacacgtattctgaatgcggcgggaagagaagcggaggcgtttgaagacaaattctggtccggcatcgaactctcgcgtctctatcaggagagccaggagcgccgggaagaactgggcggttcggagcagattttctattccggctttaaagagtttgcccgcctgcatcgcgccaacagccatgcgccggaagcggtcattgatggtgcgagccgtgcgatgcgcatctcgatgaaccgtgagctggaagcgctggaaaaccacattccattcctcggcaccgtcggtttctatcagcccttatatcggactgttcggcaccgtctgggggatcatgcacgcctttatcgcactgggtgccgtgaagcaggcaaccctgcagatggttgcaccgggtatcgctgaagcgttgattgcgaccgctatcggtctgtttgccgcgattccggcggtgatggcgtacaaccgtctgaaccagcgcgtgaacaaactggagcagggctacgacaacttcatggaagagttcactgccattctgcatcgccaggctttctccagcgatagcgctaagtaaatagaggttaatgatggccagagtacgtggtcgcaaacgccgcgacctgaagtcggaaatcaacatcgttccgctactggacgtcctgttggtgctgttgctgatcttcatggcaacggcgcccattattacccagagcgtggaagtggatctgcctgatgcgaccgattcgaaaaccgttgccagcgatgataatccgccggtgattgtcgaagtggcgggcgtgggtcagtacagcctggtcgtggatcacgatcgtatggatcaacttccgccagagcaggtaatcagcgaagcgcagcgtcgactggaagcgaatcctaagacggtctttttgatcgggggcgcgaaagaggtgccttacgatgaaattattaaagcgctcaacctgctgcaccaggcgggtgttaaatctgtcggtttgatgacgcagccgatttaaaatcgaaccgttttttgggaaccgagtgtgtcgaaggcaaccgagcaaaacgagaagttaaagcgcgcgataatcatttcggtgattctgcatatcgtgctgatcgcgctgctgatttggagctcgtttaatgagcacattgacgccagcagtgcgggtggcggaggcagtgatattgatgcagtgatggtcgatcccggtgccgtcgtgagtcaatacaatcgtcagcagaaccagcaaagtgacagccagcgggctgagcagcagcgtaaaaagcaggcgcagcagcaggctgaagagctgcaacagaaacaggctgctgaacagcagcgtctgaaagcgctggaaaaagagcgtttagccgcgcaggaaaccgcgaaagaagaggcaaaacagcaggctgagcagcagaaggctgccgaagacgctgctaagcaggcgcaggagcagcaaaaaacggcggaagcggcggctgccaaagccaaagcggatgcaaaagctcaggcagatgcgcaggcaaaagccgcggctgagcaggcgaaacaggccgcagccgaagcaaagaagcaggctgatcagcaggcgaaagccgccgctgccgctgctgcaaaagagaaagccgttgcggaagcgaaggcgaaatctgaagcagatgcgaaagccgcagctgaagccaaagtgaaagcggcggcggatgccaaagccaaagcggctgaagaggctaaacaaaaagctgctgaagccaaagcaaaagccgcagaggcggcgaaagagaaagccgcagaagccgcaaaagagaaagcggaagcggctaaagaggccgccaaagagaaggcggaagctgccgcgaaagcgaaagccgatgccgcggcgaaagccaaagccgatgctgccgctaaggccaaagcggatgctaaagcgaaagccgccgccgatgctgccgctaaggccaaagcggatgctaaagcgaaagccgccgccgatgctgccaacgacagcgatgtcgatgatttgctgggtggactcgcttccggtaaaaatgcaccgaaaagcggcacctctggcggcgcagcagggcagggaaaccagaagaaagcgggtgcatcaggcgcggaaatcaactcttacatgggtcaggttgtgagtgcgattcagagccgattctatgatgcggatctgtatcgcggaaaaacctgtgatttgcggattaaacttgcgcctgatggcttgttgattgatgttaagtcagagggtggcgatcccgcgctctgtcaggccgcgattgctgccgcaaaacaggcacgtattccgaagccgccttcgcaggcggtctacgaagtgtttaaaaacgccccaatgcgttttaaaccgcaataatgcagtaacgggcggcaagttgatctatgtttagcgtgccgtacttaagttgtactcgtggtttccaggaaacagtgccaattatcgtggactgaggttcagataagggagataaaatgaagcaagctcttcgcgttacgttaggcttttttatcctgctgtgggcagccatgctgcatgcagaagttcgaattgagatcacccagggtgtcaacactgcgcgcccgattggcgtggtgccgtttaaatgggccggtgctggcgcagcgccggaagatatcggcggcatcgttgcagctgacctgcgcaacagtggcaaatttaatccactggatcgctcgcgtctgccacagcagcctgccagcgcgcaggaagttcagcctgccgcgtggagtgcactcggcattgatgccgtggtcgtcggtcaggtcgcgtctaacccggatggcagctatcaggtttcgtaccagctggtcgacactggcggtgctcccggtaccgtgctggcacaaaacagttataaagtgacgaagcagtggctgcgttatgccgctcacacggccagtgacgaaacgttcctgaagctgaccggcatcaagggcgctttccgtacccgtatcgcctatgtggtgcagaccaacggcggccagttcccgtatgagctgcgcgttgctgactacgatggttacaaccagtttgtcgtgcatcgttcaccacagccgctgatgtcgccagcctggtctccggatggcagcaaagttgcttacgtgacctttgaaagcggcaaatctgcgctggtggtacagacgctgtcgaacggtgctatccgtcagatcgcctcctatccacgtcacaacggtgccccagcgttctcgccggatggctctaaactggcgttcgcgctctctaaaaccggcagcctgaacctctatgtgatggatctggcctcaggtcagacgcgtcagattaccgatggtcgctataacagcaccgaaccaacctggttcccggacagccagacactggcttacacctccgatcaggctggtgctccacaaatctacaaagtcggacttaacggtggcgcgccacaacgtattacctgggaaggcggtcagaaccaggatgcggatgtcgcaacagatggtaagtctatggtgatgattagcaccaacggtggtgctcaacacgtcgccaaacaggatctggaaacgggagccgttcaaacgttaacggacacgttcctggatgaaacgccgagcctggcacccaatggcacaatggtaatctacagctctactcagggtatgggttccgtgttgcagttggtttctaccgacggccgtttcaaagcgcgtcttccggcaactgatggacaggtaaaatttcctgcctggtcgccgtatctgtaatgtctgacagttcagacatcacaaacaataaacaataatgggattttgaaatgcaactgaacaaagtgctgaagggtttgatgctggctctgccggttctggcagtagcggcttgtagctcacacaagaacaacaacaatgaccagactggcatgggtgctgatggcggcgcttacggtgcaaattctggcatgaacggcaacggcggcaacatgtcttctgacgagcaggctcgtctgcagatgcagcagctgcagcagaacaacatcgtgtacttcggcctggacaagtatgacgttcagtctgattacgcacagatgctggatcagcatgcaaccttcctgcgcagcaacccgtcatacaaagtgaccatcgaaggtcatgcggatgagcgcggtacgccggaatacaacatcgccctgggcgaaacgtcgtgctaacgcggttaaaatgtacctgcagggcaaaggcgtgtcggctgatcagatgtctatcgtatcttacggtaaagagaagccagctgttctgggtcatgacgaagcagcgtattctaaaaaccgtcgtgccgttctggtctactaagagaatcacatggttagtaacttcagacatcacctgttgagtctgtcgttactgattggcgtagcggccccctgggccgctaatgcccaagcgtcaatcagtagcgttggctccggctcggtcgaagaccgtgtcaccactcttgaacgaatttctaatgcccaggcacagctgatgcagcaattgcagcagcagatgagcgataaccagcgtgatatcgacgcgctgcgtgggcaaatccagcaaaacacgtatcagttgaatcaggtggttgagcggcagaagcagctttaccagcagattgacagcctgagcagcgccagcaccagcggcggtcagcaggcagccggcagcagtgccgcagcggataccggcgcagcagcaaccgcaggcggggcagcatcaacggatagcgcacctgcgcagaccggtgacgctaacagcgattacaatgcggctgtggcgctgattctggagaagaaacagtatgatcaggcgatcagcgcgctccaggcgtgggtaaaacgttacccgaattcgacctatcagccgaaacgccaattactggctgggacagctgaactataacaaaggcaaaaaggacgacgcggcttactattacgccacggtagtgaaaaactatccgaagtcgccaaaagctgcagaagcgttgttgaaagtgggcgtcatcatgcaggagaaaaaagacacagcgaaagctaaagcggtcttccagcaggtgatcaaactttatccagacaccgaatctgctaagcaggcgcaaaaacgcctgacaagtctgtaatctgtacggttcaggccagatatcgtgtgatttctggtcttgccgtatgaaaggtaagcaactgaagcatttagcagaaataagagttgcgctaccccgctaaatcagtaatatatgccgccgttgccgggacacattgcaaagtgtctggtaagcctgaagatgggtcgttagctcagttggtagagcagttgacttttaatcaattggtcgcaggttcgaatcctgcacgacccaccatcttcctcagacgcgcttttaccgcgcagttttaagaagaacacttcagcattgcttcacaacctaagatgggtcgttagctcagttggtagagcagttgacttttaatcaattggtcgcaggttcgaatcctgcacgacccaccatcttatctcagccgcctggcgtgttgaacggttgtaagcccccagcgggtcgttagctcagttggtagagcagttgacttttaatcaattggtcgcaggttcgaatcctgcacgacccaccaattaagaaaaaagcgccctcagggcgctttttttgtttctgtggcactactcactttgaagaagcaaaacacctcaagggcttgaggttgtcgctgcccgctgtttgatcgagcctgcgcagagaacagggtcagatcggaaagacgcaaaagccgtcatccctgacctgctcggcccgcgccgtccctggcgcaggacgctttcctcttctgaccctgttccctgcgcgttgagcttctgtattgctggcagattttccccccactctcgccgtcacgcctttttctttgcctttgccactgccaggctctcccagatatgcatcactgcatagctgcgccagggacgccatgactgcgatcgcgcctccgcttctttcgatgacatgccgcccaggttattccggatggcaatatcctctttgggaaaggcatccggccagcgcaaagcgcgcatcgcgatgtagtgcgcggtccagggaccaatacccggcaggctgaccagctttttgatgacctcgtctggcgcctgagcggcactaagacgcagatctccgctggcgcaggcatttgcaaaggcgatgatggcgcgggagcgggcggcactgacaatccccatcggcgcgacatcgtctaccgtcagtccggcgatgcgttcaggatgggcggtgtagcgggtcagatcggcgaacggcgtctcacagggttcgccaaaggcggcggcaaaacggctgctgaccgtggtggccgctttgaccgtcacctgctggccgataatggcgcgcacgcccagctcaaaggcgtcgaatgcgccaggcacacgcagacccggatgcgagatcaggctgggtgccagcagtgggtcctgcgccagacaggcggcgatacgctgcggctgtgcgtcgagatcgaacagatcacgcagacggcgcagcagcagaggcagaaccggcgtcagcgaggttgagagcgtcacctgcagcgcgttcttttgcggcagatgcgaaacagagacccagccccggcagcggccgagcaccacggtgcgtcgccagcagccatcttccaccgcctcgacctctttcatcagatgcgtctgcaaaaaccagattatcgccgcccagtcatagggagggcgataggccagccgcagcgtcacgcggtcgccgggctgcgcgcattgagtgcccgtatcgtccctgcgcagcgcgcctggcgtcatgcggtaacgcgcctggaagacatcattaaagcgccgcaggctgccaaagccgctggcataggcaacgtcaataatcggcagccgggtttcggtcagcagctgtttagccagcagcatgcgccgcgtctgcttcagttccagcggcgagacacccagctcctgctgcacaatacggcgcagctgacgcaggctgataccgaattcagcggcaattgcctccagtccttcacgttcctccagcatgccttcctcgatacgctgaaccagccgctctgccacacgatgcggctgatcaaccggcgcattaccgggtgccagttcgggccgacagcgcaggcaggggcgaaagcgggctttctccgccgcttccgcgctgctgaagaaaaggcagttcttctgcatcggcgctttgaccgggcagaccggacgacaatagataccggttgaggtcacgccaacaaagaaaacgccgtcaaagcgggtatcacgagaggtcagcgcctgataggcaatgtcgggatcgagcatggcagttctccggtaaataagcgcagcctacaccggtgaatcccggcagactggctgttttcggaaagcacaacagtttatcgccatgaccgaaaacagccagtcaggctgatgaaaagtgcgataataggcgacagaaaaccgtgacgggagaatcaccatgtactacttcaaaccgatagtcaccccggtgggtgaactgaaactggtcgccagcgatagcggcctggcgggtattttgtgggaaaacgacgatccaaaacgcacccggtttttgccgcaaacgcgcgatgacgatcatcccattctgatcgaaactgagcgtcagctcagcgagtacttcaccggtgctcgtcgctgctttgagctgccgctcgattttgtcggcactgagtttcagaaaaaagtctggcaggcgctggtggctatcccgtttggtgagacgcgcagctacagccagattgcgcgggagatcggccatccgctggcggtgcgtgccgtcggggcggccaatgggcgtaatccgctctcgattgtcgcaccgtgccaccgcgtgattggagccaacggcaagctgaccggctttgcgggcggactggatatcaaagcctttctgctggcactggaagcgccgcaaaaaccgctggtactggcagatgaaacgcagcccggcagggtcggcgctgtgatgcagacagaataaatatcgcacgacacagccaggcttttccgctatcgtgtttagcatataaaacacgatggcggattggacgccataagtcgccggaacaggcgattttcgttaattagacaaaacgagagctgtgtcatgagtgtgatgttcgatccagaaagcgccgtttatccctttccgcccaaacccgctcgcctgagtgacgacgagaaggcgttctaccgtgagaaaattaaagcgctgctgaaggcgcgaaacgcggtgatggtggcgcactactacaccgatccggaaattcaggcgctggcagaagagacgggcggctgcgtttcggactcgctggagatggcacgctttggcagcaaccattcggcgacgacactgctggtggccggcgtgcgctttatgggggaaaccgccaaaatcctcagcccggagaaaaccgtactgatgccgacgctgcaggcggagtgctcactggatctcggctgcccgattgaagagtttaacgccttttgcgacgcccatcccgatcgcactgtggtggtctacgccaatacctcggcggcggtaaaagcgcgggccgactgggtggtgacctcaagcattgcggtcgagctgattgagcacctcgacagtctgggcgaaaaaattatctgggcgccggatcgccatcttggccgctacgttacccaaaaatcgggtgcggacgtgctctgctggcagggcgcgtgcattgtgcacgacgagttcaaaacccaggcgctgcagcgtatgaaagcgctctatcccgacgcggcagtgctggtgcatcctgagtcaccgcaggcgattgtcgatctggccgatgcggtcggctcgaccagccagctgattcaggccgccaaatccctgccgcatccgcagatgattgtggcgaccgatcgcggcatcttctacaaaatgcagcaggcggtgccggataaagagctgcttgaagcgccgaccgccggtgaaggtgccacctgccgcagttgtgctcactgtccctggatggcgatgaacggccttaaagccatcgcagaggcgctggagtcgggtggggtggaacatgagattcaggtggatgagacgctgcgtgaggcggcgttactgccgcttaatcgcatgctatcctttgcagcggaacttaaactcaacgtgaagggaaacgcgtaagcgttttccggacaggtgctcagcatggatttcttcagcacacataatattctggttcacattcctctgggtgccggaggctacgatctctcatggattgaggctatcggcacgctggcgggcttactctgcatctggtttgccagcctggaaaaaatcatcaactatccctttggcctgattaacgttacgctgtttgcggtgattttctttcagatccagctctacgccagcctgctgctgcagctcttcttttttgccgccaatatctacggctggtacgcctggagtcggcaaacctccgatcatcaggcggcgctgaaaatccgctggctgccgctgcctaaggcgctggcctggacggcgggctgtgtgattgcgattgcgctgatgaccctctatatcgatcctgtgtttgcgctgttaacccgtgcggccgtcacgctgatgaacggcgttggcctgtcggtggcgatgcccgcgctgcagccggatgcgttcccgtttctgggactcctgcatgatggtgttgtcgattgcggcgatggtgctgatgacgcgcaaatatgttgagaactggctgctgtgggtcatcatcaacgtgattagcgtgatgatttttgcccgtcagggcgtctatgcgatgtcgctggagtatgtgattctgacgctgattgcgctgaacggctcacgcatgtggatccgcagcgcgcggcaacagggttcccgcgcgctgtcggctcagtgagtgtgcacttcgcctttagcgtgagcatgctcatggtcgtgtgaatggctgtgatcatggccggtggcagcagcgccgcttaagccgagttcacactcggcaccggcacagggctgatactccatctgcacggtcgcatgcgcaatctgatagtgctggcgcagatagtcgtggatacgatgcagcagcgcatcgtgatcgtaaggcgggatcacctgcgcatgcagcgtcagcatcggcttttcgcccacctgccacagatgcacatggtgaacattgcgcacctctgcgatgttcagggtgagatcacgtatcagccggttcacatccagcgaacgcggcgccccttccagtaactcctgcagactctcacgcagcagcgcccaggcgctgcgcagcaccagcagtgacaccagcaacgacagaatcggatcgattggggtccagccggtcagcataataatcaccgccgcgacaatcgcacccaccgagccaagcaggtcgcccatcacatgcagcgccgcggcccgcacattgagattcttctcttcgctgccgtgatgcagcagccagaacgacagaatattggccagcaggccgccaatagcaatccccagcatcaggccgccggtcaccggttgcgggtcggcaaagcggcgcaccgcctcccagacgatcagtgcggtaatgcccagcagcgcaatggcgttaacaaatgcggccagcgtggtcagacgcagcaggccaaaggtgtggcgtgcattgggtttacggcgcgagaactgcaccgccagcagcgccatcagcagcgcggcggcatcggtcagcatatgcccggcgtccgccagcaacgccagtgaacccgagagccagccgccaatcacttcagccaccataaagacaacggtcaccccgaaggcggccgccagacgcgtgcgattactatcctgcccgctatgagtgtgggtatgtgccataagattccagttttttcagtaacctgtttgctaataatatcagtaattgccacgtctcagacgtgtcctgatgctgttttgcctgctccgccagttgctggctgagctgtgcgccgtgctccagtcccaccagtaaccagcttcctttcatccggtgtgccgcttcggcgaaacggcatccacgcctcgcgctcgcgtgcttcgcgcatcacggccagatcctgtgtcaccgtgctgtgcagcgtctggctcagacggcggaggaatttctcattctgctgtgccagttgccacagattgtcatccagcgccgccagcggatcttcctgccactctgccagcagcgcgctgagatcggctaactgcaccggttttatcattacccgctcccgcgcctccagcggtcgtgacagcagctgggcatccgcggagcagagcacccgcatcgcctgacgcttccgctgacggtcacgccgccgcaatatccgcagcagcagcgtgccgtcaggccgcggcatcatctggtcgataaacagcaggtcataaggctgttgcgcatcggcctgcagtagtgcgcgtccctgctcaaagatgtcagcctgaatcgcaaaacgcgacagctgctgctgcatcaccagcagattggtcggatggtcatcgacaatcgccacccgcagcggtggaaggtcgggaagggcggtttcatccacgtggtttgctggtgcgcagaccgccagtggcagcgtcacggtgacctgggtgccgtgaccgggttcagaggcgagccggatgtcgccgcccatccgctgcaccatttcccggcagataaacagccccaggccgctgccctgcaccgaaaccgatttaccggacggcgcctgataccagggatcgaacagcttctgctgctcctctggcggaatgccgctgccgctgtcgctcaccgtcagaatcagctgttgttgctgtgcggccagcgtcaggcgaatcgcgccgtggcgggtaaatttcagcgcattggtcatcaggttgttgaccacctgctgcaggcgatcggcatcgatcatcacggcatcaggcagcggcgtcagtgcctcgacgatcagatgcgggccgtcttcgcgcattaacggatgataaaagtgctgctgctgattgagccactgcgccagcgccagcggacggggcgccagggtaaaactgttgctctcgatgcgcgcatgatcctgcagatcattcagcaacgtcagcagcgattgcgcactgctgtgcagcagcgtcaggttctggctgctgtgctgctgcttctccagctccagcagtcccaggatcgcctgcatcggcgtgcgcagctcatggctgacggtcgccaggaactggctcttcatcgcattggcgtgctcagcctgttcacgctgctgacgctcccggcgctgttgccagtagcggcgcgccagcagcagcagcagcagcgcaatggccgcacctgccaccgccagcaccatcatcggcagcgaacgcatcaccatcacgctgccgggctgtggcggggttgaccagctgtcgcgcatctgactctgtgtgtcagccgggatctgctgcagcgcgcgatccagcagggtgcgcagcaccggctggtcagccgtcacgcccagcgcgatcggccaggcgatgtcgctggcggcaaaggcgaggtggatgcgcgcatcatcgcggctggcgatacgccagcgggcggagagcacgttatcgaccagcgcatcgatctgcccttttgccagcgcgtcatagaggctattacgatcggcaaactgctgcggctgcagatcctcaggcagcagacgcagcgccaggtcatcctgcaacacgccgacccgcttgccgcgcagatcgcgccagtgcgccagcgtatcgggctggagggtgtagatgccccacagcgcgcgccacaccggcagcgaggtgctctgcatcgcatcgccgttcagcggctgcatcagctgcagcatcgcctgctgctgaccgatcagcgtgttcgcctgacgcggattgctgacccacaccggttcaaactgcaggccggtgctctgagctatcgctttcagcaaatccacgccatagcctctggcggtcccgctggcatcgcgataactccagggatagttgtccggttcggcggtgtaagtaatacgcggatgatcggcaatccaggcgcgctcagtggggctgagcatcagggtctgcgtatcctggtagcgcggcagggtactgctccagcgcgcctgcagcgtgttcatcagttctgctggcaactgacgcaggctctgattaatccagctgataagctccggatcgcgggagaccgcgcgcaggttgagctgtccggcctcgatgtgtgaggcgatctgataaatctggccctgttgcagctggctcagcagaaatccggcgctggtctcatccgccaccacataatcattctgctgattcagcagggtatagagcgcctgcagatcactgctgtagcgtcgccagctgtggcgggccgccagcgcaggcggcagttgtgccagcgtgctttcgctgatcgccagttgggcattctggctgttaaacatcacggcacgctggttttgctgattgcggtagacccgaagcgggctgctgtaccagttatcgctgctcagcgcgccggctggcaggggagaaatccacatgccaagcgcaaaatcgatctggccgctgttcagcgcctgcatcagatgcggctgatcgctgtagaggttgaggctgaactgcgcgccagtcagctggcgcagtgcggaaagatagtcagcattgatgccatacaggtcgttgccgatgcgcatcgcccagggggcgtggttctcttccagcaggccaacacgcagaattttgccctgcatggtttccgcgtgtgtcaccggcagcatcatcggcagattgatgctgctcaccggacgcacctcagccagaaacggagccgcacagcaacagcagcatcagcaggagagttctcactgctgcgccttccacaggtcagccagttccaccaccgaacgggcgccggttttttccagaatgttctttttatgggtgctgaccgttttattactgatgtgcagctgggcggcgatttgcagattggacaggccgctggccagcagcgccagaatctgacgctctttctgggtcagcgggagttccggctcatcatccatcaccggaaacgccgtctgaccgcccagcaccgccaggatagcgctaagcagttgcgccatgcgctggctcttcaccacataaccggcggcacccagcgcctgggcacgacgcacatagtggcgggtctgctgagcagagtagatcaataccggacagtcggggcgatggatcttcaggcgacgcaggaactccagcccatcgctatccggcaggccaatatccagcacgatgatgtccagtggctgctgaagcaggggacgggcggctttttcactgctggcagagaggagctgaaccggaatgggcgactggctcagagcggcttcaagtgccacttcaaccagcggatgatcgtcaatcagaagcaaaacggccatgaaggatttcctgtaaaattcacaggattagcatagcggaagagtgggacagaggggagaaaaaccaggagagcgtcagctctcctggctaaacagaattactgggtggtgccgtcggttttggtatctacgtcaccgccgcccactttagtctgaacttttttattgatgttcggacatttaccatctttacactgggcgttctggtccatttcgttagcagacatattaccatggctggtggtgctgccagacgttgcaggattggtatcgttgccagtgttattaattttgctgttatcgacattatttggcggcagattctctttcgctccgcccgctgctgcacctgcactggctgcctgattcgatgtaccgttattgctgctgctgtctgcagccagtaccgcaccgctgctcagtgtcattgctgctgtcaaaaagagtaaggcaaactttttcatcattatgctcccgttaataaatgaagatgctttaagcccagaggtgcaatttcgggtaagaaaatccctgacgaaatataattcgccggttggcttaaacagggtgatttaatttggtaagcgggacgttcctcagtgcttaccattaaaaagtctagtcgctaacctgattaatgcaaatatcacccgcacatttaacccgcagcgggaatttacaccccaggcgcttcgggctacattgggcaggttgtgtccggcgggcgccgggccagaaataatatggaatcagtatgaattaccagaacgatgatttacgcatcaaagagattaaagagctgttacctccggttgcgctgctcgaaaaattcccggcgaccgatcgtgctgcacagaccgtttcacaggcccgtcaggcgattcatcagatcctgcagggcaaggacgatcgcctgctggtggtgattggaccctgctcaattcatgacactgaagcggcaaaagagtatgccgaccgcctgctggcgctgcgtgatgagctgaaaggtgagctggaagtggtgatgcgggtctattttgaaaagccgcgcaccacggtgggctggaaagggctgatcaacgatccctacatggataacagctaccagctcaacgacggtctgcgtctggcgcgtaaactgctgctggatattaacgacagcggcttaccggcggcgggcgagtttctggatatgattaccccgcaatatgtggctgacctgatgagctggggcgcgattggcgcgcgcaccacggaatctcaggtacaccgtgagctggcgtccggtctctcctgtccggtcggcttcaaaaacggcaccgatggcaccattaaggtggcgatcgatgccattaacgcggcgggatcgccgcactgtttcctgtctgtgacgaagtatggtcactccgccattgtggaaaccagcggcaatggtgactgccatatcattctgcgcggcggcaaagagccgaaactacagtgcgcagcatgttgcagaggtcaaagagggcctggcaaaagcgggtctgccacagcaggtgatgatcgatttcagccacgccaacagcagcaagcagttccagcgtcagatggttgtggcagacgatgtctcacagcagctgattaatggtgagcaggcgattgtcggtgtgatgatcgagagtcatctggtggaaggcaaccagagtctggagagcggcgagccgctggtctatggcaaaagcgtcaccgacgcctgtatcggctgggaagataccgacaaggtgctgcgtcagctggcggcagcggttaaacagcgccgcggccgagtgggataactgacaaggtctgacccggttcgcgttgaggattgtgcctctgaccgtattccctgcgatttgagccaatcagttgttgccaggctcattgatctctttattctgacaacgaacacagtgcgcagcgtccgtgcgcgcagcccaataaaaaaggccagactttcgtctggcctttttgcatttcagcgagaaattacttcgctttaccctgattcgcaacggctgcagctttcgcggcaatctcgtcctggtcgcccaggtagtagcgtttcagcggtttgaagttttcatcgaactcatagaccagcggtacgccggtagggatgttcagttcgaggatttcatcttcgctcaggttatccagatatttcaccagcgcacgcagtgagttgccgtgtgcggcaatgatcactttctcaccgcttttgatgcgcggcagaatggtgtcgttccagtaagggataacgcggtcgatggtcagcgccaggctttcggtggttggcagctgctctggggtcagtttcgcgtaacgcggatcatggcccgggaagcgctcatctgaacgatccagctctggcggagtaacggcaaagccgcgacgccactgcttaacctgctcatcaccatatttggcagcggtttccgctttatccagaccctgcagcgcaccgtagtgacgctcgttcagacgccaggttttctcaaccggcagccaggcctgatccagctcatccagcacattccacagcgtgtgaatggcacgcttcagtactgaggtgtaagcgaaatcgaaaacaaagccctcttttttcagcagctgacctgctgatttggcttcgccacgacctttctcagaaaggtcaacatcataccaaccggtaaagcggttttcgttgttccactggctttcgccgtgtcgcaccagaaccagcttagttacagccatagcttaactccttaatactgtgatgtttctgtgagattggaaacctgctgctgcccgcctgacacgcgagctgattgcgccataccataacggaaaagcgggcagcgcgtaagcctgtgtgtgacgcactgcgcgtttttcagccggaggctcagcgtggcgtgaagcgataacgcgtcacggattcccagcgatctcccggctgcagccagcaatcaggctgaggccattcatcatgattaggcgaatccggtaaaaattcgctctccagcgcaataccctgaaatgcagtatagctcgcctgctcacgggcacgggtgcccgccaggtagttgccggagtagaactgcaacgccggtgccgaagtggtcacgctgagctgcagtctgccatcttccgaccagagttttctgccgcaggctgagtgtcgtcgcctgcgctgttgagcagaaacgcatggtcatagcccttcaccgctcgctgatcgtcgtctgccagaaactcctgtgccacgactttggcctcgcggaaatcaaaactggttccggcaacctctttcagcggcgcattcgggatgccttcgctgtcgaccggcagataatggtcggcgtgcagttgtaagcgatgctggcgggcgtcgccatgatgcgcatcaaggttaaagtaggcgtggttagtcagattgaccgggcagggctgatcgcagcgcgcttcatagctaatgctcaggcagttctggtcatccagctgatagcgcagatcggcaatcagattgccgggatagccctgatcgccatcggacgaatcaatgcggtagtgcacctcgctgtcagactggctgacaatctgccagcggcgcttatcaaagccttccggtccgccatgcagctgatgtgcgccctggttcggcaccagctggcggttcagtttattcagttttgccccggcgatgcggttagcgtagcggccgaccgtcgcgcccagataggcatcctgatggagatagtcagagggcgtggcgcagccgagcagcgcttcacgcaccgtgccatcctgcatcggcacgcgggcggagagccaggttgcgccccagtccataaaggtggctagcatgccgttggcattgcgcagcaccgttatgcgccacggctgaccgtcgggcgcgtgggagttgacgtcgttcagcattggccggctccttcagaggctttgcagacgtagaaggtctctttgatgccggtcgctgcttcatactgctgcgctacggcggctttgacctgatcgaccagatccagtggcatcagcgcgacgatacagccaccaaagccgccgccggtcatacgcacgccgccgcgctcaccgatctgcgctttcacgatctctaccagggtatcgatcggtggcacggtgatctcgaagtcgtcacgcatcgaggcgtgagattcggccatcagctggcccatacgggtcaggtcgccctgcgtcagcgcatcggctgcttccagggtacgggcgttctcggtcaggacgtgacgcacgcgttttgccacctgcgggtcgagctgcgcctgtgccgcttcaaactcggccagttcaacgtcacgcagcgccttcttattgaagaaacgcgcgcccgcttcacactgctcacgacgcgtgttgtattcgctgccaaccagggtacgacggaagttggagttgatgatcaccaccgcgatatcttccggcatcgacaccggacgcgtgcccagcgtgcggcagtcgagcagcatggcgtgatctttccggcccagcgctgagatcagctggtccatgatgccgcagttacagccgacgaactggttttccgcttcctgaccattcacggcaatggcggcgccatccagcggcagattatagagttgcaccaccacggtgccgaccgccacttccagcgacgcagatgagctgaggcccgcgccctgaggcacgttgccgctgatcaccatatcgataccgccgaaatcggcatgtcgctgctgcagatgtttcaccacgccgcgcacatagttggcccacatcggttcctgcaggctgacgatctcttcatcgagagagaatgtgtcctgcgcattttcataatccgccgcgaccacccgaatctggcgatcgtcacggcgggcacaggcaatcaccgtctggtaatcgatggcgcacggcagcacgaagccgtcgttatagtcggtatgctcgccaatcaggttaacgcggcccggtgcctgaatggtatgcgtagcggcgtaaccgaaggtgtcagagaaaagctgctgcgtgatggtttttaagctcattgttgtgcctcacggaagtgaacgtcgctgacagaaacgcagacgttccgccgcctgttccgccgttaaatcgcgttgggtttcggccagcatttcatagccaaccataaatttacgcaccgttgctgagcgcagcagcggcggatagaagtgagcatgcaactgccagtgatcgttggcttcgtcgttaaacggcgcgccgtgccagcccatggagtaggggaatgagcactggaacaggttgtcgtagcggctggtcagcagcttaagcgccagcgccaggtcagtacgctgcgcctcattgaggtcggtaattcgtttgacgtgcgctttcggcagcagcagggtttcaaacggccaggcggcccaccacggcaccaccgccagccagtgatcggtttccaccacggtgcggctgccatcctgctgttcacgtgccagataatcgaccagcatcggcgagccatgtttagcgaaatagtcgcgctgatgatcatcttcacgctgcgcttcattcggcaggaagctgttggcccagatctgaccatgcggatgcgggttggagcagcccatcgccgcgcctttgttctcaaacacctgcacccagggatagtgctgacccagatcggcggtctctgcctgccaggtacgcaccacctcttccagtgcgttcagcgacatctccggcagggttttgctgtgatcgggcgagaagcagatgacccgactggtgccgcgtgcgctttcacaacgcatcaggatatcgtcgctctcgggcgcgtctggcgtgtcggtcatcagcgcagcaaagtcattggtaaaaacgtaggtgcccgaatagtccgggtttttgtcgccggtgatgcgggtgtttccggcacacaggaagcagtccggatcgtgcgccggtaacgtattgaccgccggggtttcctgcgcgccttgccacggacgtttggcccgatgaggtgaaactaaaatccattgatcaatcagtggattgtaacggcgatgcgggtgatcgaccgggttgaatttttccatgttagatcctggtaagcgtcaaaagccaaagaggcatcggtaaaaagtagcacatcagcgcgcccgaaagcgtgatcaagtctggataaatggtatcgtttacacaagctgaatattcttatttcgtggcaatgtgcgcggatatatgacgtgaaaggtgatgtggaatggtagcgcttacacaagagcgctttaaaacgccgcagcagcggcgtggggtgaagcgttacatgagccctagtgcagggtttcctgctgaaagtgatagccgccgtcatgggcgataaagctcaggcgatgtgtaatgcaggcgggcgcatcttccgcgtgatgcgaaacaaacagcagctgagtccgtccctcgccaatcagcacatcgacaaagcgccgcacgagctggcggttaatcgggtcgagcccctgtagtggctcatccagtatcagcagcgtcggatgcttaaccagcgcgcgggcaatcagcaccagccgctgctgtccccatgagagcgagtggaacggcgcatcggcctgtccgttatccatccccagcagtgccagccactgctgcgccagcgatttttgccggtcagaagccgcctgatagagaccaatggagtcgaagaagcccgacaggatcaccgtgcgcacattggtgctgacgcggtaatcgagatgcaggctgctgctgacatagccaatatgctgcttgatatcccagatggtttcaccactgccgcgacggcggccaaacagggttaaatcattgctgtagccctgaggatgatcgccggtcaccaggctgagcagggtcgatttccctgcgccgtttcgggccggtaatctgccagtgctcgccggcgttgacctgccagttcagcccctgaattactggcttatcgttatacgagacggtgccgttgcgcaggataacgcgcggcgcatcatccgccagcgatggcagctgatccggcgcatccgcctcaggtaacgccattcccatcagctgttcactgtgtgccagctgcgccaccagcgcttccgttaaaatggcctggcgtggcccgctgtgggtgagggtgcactccgccagcacgccaacctgctgaatgaaatcgggaatatcgtcaaagcgattgagcaccagcaccagggtaaatgtcggttgctgcaggccgcgcagcgtgtcggtcaggctggcgcgcgacgccacatccagcccgtcaaacggctcatccagaatcagcaaatctggctggttcatcaatgcctgacagagcagggttttgcgggtttcgccggtagagagatatttgaagcggcgtgaaagcagcgcttcgatgccgaactgctgtgccagctgctcgcagcgctcgggctgctgcacctccgcctgaatcacctctgccacggtcagcccggtatcctcttcaccttcgctgagcatatcggtgttgttgcgctgccactcctgcgccaccagggtttgtagctgctccagcgacagccggaccggccgtctgaaatcgctgctgactgaaccggccagcggcggaagttcaccagagagtgcgcgcgccagtgatgatttgccgctgccgttggctccgacaaacgcccagctttcgccgcgctgcagttccacctgattcagactcagtatccgggtatcgctaagacgaaacgtgccttgcgaaatgtgcaatgaagccatgatctgttccattttttgcatcgtgtcactgagttgtaaccattgcccttaatgaagtcaaatcaaccgctagagcagggtggcgacgatggcgtgttcggcattgaaactggcgatcacggcgtcgccgggctgcagcctgagttgctgcagctgatcgttgctcagggtcgcgcacagggtttcgccgctggcgagcttcatcagcacttcactcatctgctcgccgggttcgatggcactgaccgtcgctgccagctgattgtcatcctgtgcggcgtcacgactgatgcggatccacggcgccttgatcagcaccagcacctctttacctgcggccagttgcaggcgatcggcgctgcgctgggtcagcgccacattaagctgcgtgacgccatcggccagttgaatcagcagatgctggaccacctgctgcgcatcgttactgacgacggtgccaaacagctggttacgggcgctggtctgcagcgagaaacgggcgatggccgccagcagactgtcgagcggtaacgtatcctgctgcagcgcatcaaaggctttctgctggatctgctccatcagctggaacagctgaatcaggcgttcaccgtagcgggtcagcgttgcaccgccgccgcctttgccaccggtggcccgctccaccagcgtttcatccgccatctggttcatctcattaatcgcatcccaggcacttttgtagctgataccggccagcttcgccccctgactgatcgacccggtctgctgtacgcgtttcagcagctcaatacgtcgcggatcggcaaacagtttctgttgtaaacggatatgaagggacagttcggcttccatgacagctccggcaaagggttaaggcgaaggccgatgatagcggcgttttgtgaccaaagtaaaagcacgaaaagggctgcgcaaaattttgctgacccgttacaatctcttttttgttagcagagtgagactctccatgctggaattacttaaaagcctcgccgttgccatactgatggtgcctgtcgtgatggcgctgatgctgggcatgatttatggcctgggtgaagtgtttaacgtcatctctaaaattggtcatcgcgaaaaatcctcagcccgttcgcacaattaattgcagccacgcccgccatctgcgcgggcgtggtcgtttttatctctcctgatttaaccttttgttccccctgccgataatttactgaacctcactgacattgcgctatattatccgctacacaacgaatagccggagaaaatcatgtcatttaaacactatcgctggggcgtcgcggccctgatcaccgtttcgctggccgggcaggctgtggccgccgacaacatcactgtgtttgccgcggcttcactgaccaacgcgatgcaggatattgccagccgttacaagcaggaaaagggggtgacggtggtctcttcgtttgcctcctcttcaacgctggcgcgccagattgagcagggtgctcctgccgatctctttatctctgccgatcagcagtggatggatgatgcggtggcgaaaaaaagtgtgattaccagtagccgctataccctgctgggcaacgatctggtattgattgcgccacgcagtgccgccgcgaaagcggtgacgctggacccgcagactgactggaaaaccttgctgcacggtgagcgtctggcagtcggcgatccggaccacgttcctgcgggcatctacgccaaagaggcgctgcaaaagctgggtgcctgggaaggcgttgcgccttcgttagcgccagccaataatgtgcgggcagcgctggcgctggtcgagcgtaatgaaacgccctatggcattgtctacgggtctgacgcggtcgccagcgataaagtgcaggtcgtcgggcattttccggcaaccagccataaacccgtagaatatccgatggcgatcgtgaacgatcacgacaacgccgccgttaaagcgttttatgattatctgaaagggccccaggccgcggctatctttaaacattacggattcacaccgacgaaatgatactcagcgatcccgaatggcaggcggtactgcttagccttaaagtctctggcatagccgtgataggcagtctgccgtttggcatcctgatggcctggattctggtgcgctgccgttttcctggtaaagcgctgctcgacagcctgatccatctgccgctggtgctgccgccggtggtggtgggttatctgctgctgattagccttgggcggcgcggcatcataggcgaaaagctttatgactggtttggcttcagctttgctttcagctggcgcggtgccgcactggcctctgccgtgatcgcctttccgttgatggtgcgtgccatccggctggcgctggaggcggtggatagccggctggagcaggcggcgcgcacgctgggcgccggacgctggcgggtctttttcaccattacgctcccgctgacgttgccgggcgtgatcgttggaacggtgctggcgtttgcccgatcgctgggcgagttcggcgccaccatcacctttgtttccaatattcccggcgagacgcgcacgctgccgctggcgatgtttaccctgatagagacaccgggtgcggaaggggcggcggcacggctctgcgtcatcgcgatcgtgctggccctggcgtcactgctggcgtcggaatggctggcacgtgcaggccgtaagcggatgggaaactgatgctatcactcaacattatgcagcagcagggcgatcacgtgctggaggtcgacctgcagatcccggccaaagggatcaccgctattttcggcgtgtcaggtgccggaaaaacctccctgatcaacgcgatcagcgggctgacccagccgcagcggggacggatccagctgcacgatcgtctgctgtttgatgcagagcagaagattgcgctgccgccggaaaaacggcgtatcggttatgtattccaggatgcgcgactgttcccgcactatcgggtccgtggcaacctgcaatatggtatggcacctaagatgaaagcgcagttcgacagtctggtctctctgctggggttggaggcgctgctgccgcgctttccgctgtcgctgtcgggcggggaaaagcagcgggtcgcgattggccgtgcgctgctgaccgcaccggatatgctgctgctggatgagccgctggcgtcactggatctgccacgcaaacgtgaactgatgccctatctgcaaaagctggcgaagcaggtcgatattccgatgctctacgtttcgcacagtctggaggagatcctgcagctggctgataacgtgctggtgctggatgcgggcaaggtcaaagcctttggtccgctggagcgggtctggagcagcagcgcgatgcggccctggctgccggtgagtgaactgaccagcgtgctgcgggtgcaggtgctggaacagcatcccgactatccgatgaccgcgctgtcgctgggcgatcagcacatctgggtcagccgggtgaatcagccggttaaaaccccgctgcgtattcgcattgcctcggccgatgtctcgctggcgctgcaaccgccgcaacacagctccatccgcaacattttaccggcacaggtggtggaattgctggaggtcggggaccaggttgaggtgaagctgcgcatcggcatcagcgaactctgggcgcgcattacgccgtgggcgcgggatgagctgggcatccggccagatcagtggctttatgcccagatcaaaagcgtctcggtgacgccctgattacaacacgtactgatagagggtatcggcaataccggtttcaaggttggtgccgatcaccattttcgcccgcgctttaatcgcctcatcggcattacccatcgccacgcccagtccggccgtttccagcatgctgagatcgttatagttatcaccgaacgcgatcacatcggacatactcagccccagtgattcaacccactgcgccagtcgtttgcctttgctgttgccgcctttggcgatatccacctgatcgtgccacgaccattcgcaggccagtcccagttccgcttccaccctggtggcgaactgctgcagttccgggatgttgttgtgcgacagggcaaacttccagatcgaaccggcgtcgcgtgccgcctgggccaggtcgggcacctggcggaacagtggacgctggtgggcaggcagcgattcggcccacttcagggtgcgcatcacgtggccggtcggggtctgatagagcatcgcatcatccacgtagagcaacccgtgaatctgctgctgattcagcatctcaattacctgcaacgccagttgcgggtcgaggggatcggacgccagcacctttttcgcctggtaatcatacaaataggtgccattacagcagattgcgggtgtatccagctgtaacgcctgataaaaagggtggatagcgcagtgatggcgtccggtcacgatagcgacatgaacgcccgcctggcgtgcctgatttagcgcttcgattgactgcggcagaatcgttttggctggggtcagcagcgtgccgtcgaggtcgagggcaattacacggtagctcattaatcctctcgtttttcctggtttgcaggggctgaagtctacacctcaccacggtccggagacaaaaaacagggcacaaatgatcccagcgtagggcaataaaacaggctacagtgattcacagatcatgatcaggcagcaaaaaaggagaatgcatgaaacaagttgtctacaccgccagtcccgagagccagcagatccacgtctggcagatgaatgatgagggcgggctgacgttgcttcaggtgaccgatgtcgccggccaggttcagccgatggtggtgagtccgaaccgcgattttctctatgtcggtgtgcgtcctaatttccgcgtgctggcgtttcgcattgccgccgatggcacgctgaccgaagcgggtcaggcgcctttgcccggcagcccgactcacatttccaccgatcgccagggcaggttcctgttctgcggctcctacaatgatgcctgcgtcagcgtcagcccgattggcgatgacggcattccgcaggccccgctgcaggtgatcagcggactggatggctgtcactcggccaacatcgataatgacaacaagacgctctacgtgccggctctgaagcaggaccgtatctgtctgtttaagctgggcgaagacggtcagctgacgccgcgtaaacagacgcaggtcacgacagtagaaggcgctggcccgcgtcatatgcagttccatccgggcggccagtatgcttactgcgtgaatgagctcgacagcacggttgaggtgtgggcattaaatacgggcgaaggcgaagcagaaagcgtgcagacgctggatatgatgccgcctgacttcagcggtacgcgctgggcagccgatattcatctgacgccggatggccgtttcctctatgcctgcgatcgcaccagcagcacgctggcagtcttcagcgtcagcgacctgggcgatgagctgaccctggaagggttccagccgacggaaacgcagccgcgcggatttaatatcgatcacagcggacgctatctggtggcggcgggacagaaatctcatcacatcgaagtttatgcgattaccgaaccgaaagggctgctaaagccgctgggacgttatgcggtggggcagggcccgatgtgggttgtgattcatcagttacaggcgtaacccgctacgaaaaacgcctctcctgctcaggagaggcgtgctgaattactgataattcacggtcagcgaggcgctcgccagtgcgtggaaatgcacattaaagccgaccattgcgccactggcgccttcatctacttcaatcgtctccacatccagcgcatgcacggtgaaaatgtagcgatgggtttcgccctgtggcggcgccgcgccaccgtagcccgcctgaccaaaatcggtacgggtctggattgcgcctgctggcagtgatgctttgccggaaccggcaccctgcggcagtgacgtcgagctggccggaatattcgctaccacccagtgccaccagccggaaccggtcggggcatcaggatcgtagcaggtcaccacaaaacttttggtaccctctggtgccgcttcccaggcaaggtggggagagatgttctcgccctgataacccatgccgttgaaaacatgcttttcaggcatcttctcgccgtcattaaaatcctgactaaaaacgcgcatcacatctccttaattgtcgatgaatagcctgtcatcataaccaaaagtgccgtcagtgccagcggtcagcccgcttcaggcggcaaaatgttgagaatgctccagcgcgccgccaatcgcctgcaccagcctgctcagcgcctgcggcgtgatgatgtagggtggcatcaggtagatcagccggccaaaaggccggatccagacgccctgttcaacaaagaactgctgcagcgccgccatattaaccgcctgatgggtttccactacgccaatcgcgcccagcacgcgcacatcggccacctgcggtgaactgcgcagcggcagcagctcagcccgtaactgctgttcgatcgccgtcacctggcgctgccagtgaccttccgccagcatggtcaggctctccgccgcgaccgcgcaggccagcggattgcccataaaggtcgggccatgcataaagcagcccgccgcgctgcggctgatggtgtccgcgacctcgcggctggtcagggtcgccgccagcgtcatcatgccaccggtcagtgctttgccgacgcagagaatatccggggtaatgcccgcatgctcgcaggcaaaaagtttgccggtacggccaaatccggtggcgatctcatccgcaatcaacagcacgccatagcgatcacaggcttcccgtacctgctgcagatagcgcggatggtagaaacgcatgccgcccgcaccctgcacaatcggctccagaatgacggctgccagttgccggtgatgctgttctatcagcctggcgaaatcatcgaaatcaggcttgtgccatttatcatcaaagccgcaggccggggccgccgcaaagtgatgctcgggcagatagccgcgccacaggctgtgcatcgagttctcggggtcgcacaccgacatcgctgcaaaggtatcgccgtgatagccgcgtttcagcgtcaggaaactgctgacgcgtctcgccacgccccagccagtactgcagcgccatcttcatcgacacttccaccgccaccgagcctgaatcggccaggaagacgcactccagcgcctcaggcgtcatcgccaccagctgacggcagagcgccaccgccgccggatgggtaatgccgccaaacatcacgtgcgacatctgggtgacctgctctgtcagcgcccggttcaggcgcggatggttgtaaccgtggatcgccgcccaccacgaggacatcccatccaccagctcacggccatcggccagttgcagctgaaaaccctgtgcggcgaccaccgggtagcagggcagcggatcctgcatggaggtatagggatgccagatatgctggcggtcaaagcgggcatcgtctgaggagaaaacggggatagtcatcggagttgtaaaccaaaataaaaaaatatagtttacaagtataaccctgcttttcgtcgggatgacaccctttttggagtaagtaatggctcaacgctggacaattgcacaggcgcaagcgctgtttgatcaaccttttcttgaactgatgtttaaagcgcagcaggtgcatcggcagcacttcgatccgcgccaggtgcaggtcagtaccctgctgtcgattaaaaccggtgcctgtccggaagattgtaaatactgcccgcagagcgcgcgctacaagaccggcctggagtcggagcggctgatggaagtggaagaggtgctgacctcagcgcgtcaggccaaagccgccggttcaacccgtttctgcatgggtgccgcgtggaaaaatccgcacgagcgcgatatgccctatctggagaagatggtggaaggcgtgaaggcgatgggaatggaaacctgcatgacgctgggcacgctcagcgagcaccaggcgcagcaactggcgggcgcggggctcgatttctacaaccataacctcgacacctcaccggaattctacggctccatcatcaccacccgcagctatcaggaacgtctggatacgctgggcaaagtgcgcgacgccggcatcaaagtctgttcgggtggcattgtcggcctgggcgaaaccgttaacgaccgcgccggtctgctggtgcagttagccaacctgccaacgccgccggagagtgtaccgatcaatatgctggtgaaggtcaaaggcacgccgttggcggataacgatgatgtggaaccgttcgattttatccgcaccatcgcggtggcgcgcatcatgatgccgacctcgcatgtgcgcctctcagcgggccgtgagcagatgagcgagcagacccaggcgatgtgctttatggccggggcgaactcgattttctacggctgcaaactgctgaccacgccgaatccggaagaggacaaagaccgcgtgctgttccgcaaactgggtcttaacccggagcatactcacactcagcacggcgatcagcagcaggagcagcaactcagcgagcagctattccatgccgacactgaacagtttctacaacgcggcgctgtaatgggctggcagcaacgtatccgtcaggcgctgacgcagcgccgggcggccgatggctggcggcagcgacgggtgatcgatcagcaatcgacccgcacgctgcacagcggcggccgcagctatctccacttttccagcaatgattatctcggcttaacccagcatccggcggtgattgcgggctggcaacagggcgcggcgcaggcgggcgcaggtgccggtgcttcagggcatgtcacgggttatcaccgtcagcacgccgatcttgaggcgcagctggccgactggctcggctacgaccgtgcgctgctgtttatctctggctttgcggccaatcaggcggtcattcatctgctgggcgagaaaaacgatcgcatcctggccgataaactcagccacgcctcgctgctcgacgccgccagccatagtccggcacagctacgacgtttccatcacaacgcgccggagagtctggcagcccggctcgcctctccctgcgagggcgaaacgctggtggtgacggaaggtattttcagcatggatggcgacagtgcgccgctggccgccctggcgcaacagacgcgccaggcagagggctggctgctggtggatgatgcgcacggcatcggcgtggtgggtgagcaggggcgcggcagctgctggcagcagggcgttaaaccggaactgctggtggtcacctttggcaaagcctttggcgtcagcggtgccgcgctgctgtgcgacgcagccaccgccgactattttctgcagttcagccgacatctgatctactccaccgcgatgcccgcggcgcaggcgagcgcgctgcaggcggcgctgcgtgaagttcagcaaggcgatgccctgcgccagcaactgcaacagaacattggccatttccggcgcggtgcggcctcgctgccgtggcaactgatggactccggcagcgcgattcagccgctgctggtgggcgaaaatggcgatgcgatggcgctctcccagcggctggctgaggcgggctgctgggtcagcgcgatccggccaccgaccgtgccgccggggacggcccggctgcgcatcactctgaccgcggctcatcgccccgaggatattgaccggttactggaggcgctgcatgacgctgcgggttgacaagcaggcggtggctcgcgcctttggccgggcggccagccattacgatgcccatgcggcgctgcaacgcctcagcggcgatgccctgctggcactggcgcccgcacagagcggtctgcagctgctggatgccggttgcggcaccggctggtacagcaggctgtggcgcgaacgtggcaaacaggtaacggctctggatctctctccgcagatgctgcaacaggcgcgggacaatgacgcggcgcagcactatctggccggtgatatcgacgcgctgccgctggcggataacacgattgatctggtgtggagcaacctggcggtgcagtggagcgaggatctgcccggcgcgctgagccagtttccggcgggtgctgcggcccgatggcacgctgctgttttccactctgggcgacggttcgctgcaggaggttcatgaagcctggtcccatctggatgcgctgcctcacgccaaccgctttctcagcgagccgcagattgcggcggcctgccacgcagagcagctgcgctgtacctcagaggtggtgaccctgcattttcccgatgcgctcagcgccatgcgctccctgaaggggattggcgcgacccatctgcatcaggggcgtgacgggcaggtattaacccgacaacggctcaaccagttagaggcgcactggccgcgcgatcggcacggctatcgcctgagttaccatttaatctatggagtaagtgcatcatgaaacgcctgtttatcactggcaccgacaccgaggtcggtaaaaccgtggccagcggcgggctgctgcaggcggccgccgccgcgggctatcgctgtgcgggctataagccggttgcctcaggctgtgagatgacgccagagggcatccgtaacagcgatgcgcttgcgctgcagcgttacagcagcgtgccgttaagctatcagcaggtcaatccgctggcgtttctcgagccgacttcgccgcacatcgtcagcgccgaagagggcaggccgatcacccatctggcgctgtcggcgggtctggcggcgctgcaaccgctggcagactggattctggtagagggcgcgggcggctggtacaccccattgtcggagacgcacacttatgcggactgggtggtcagcgaaaagctgcccgtgattctggtggtagggattaagctcggctgcatcaatcacgccatgctcaccgctgacgcggtgcgggcaagcggcctgccgctggtgggctggatcgccaacaccgtcgaaccgccgggtaaacgctatcaggagtatctcaccagcctgaaaaacaggttacctgcgccctgtctgggcaccatcccgtttatcaccgatgcggcgcagcaggcgtcctgtggtcactacctgacgctgccggagtaaccgcctggcctggctattttatttgtcatgctgaatccgggcagtgctcaccatcctcacgcgctgtgcacacgctccggtggttccgcgcgctccgtctccagcctgcctgcaacacttacgcccggtggggcaggcgctgagtgtcaggccaccgtcagccatttatcgacggtgtggtcatcaagctgttccatgctgccctgcgccacattgcggccgcggtgcagcagcaggaaatagtccgccacgcgacggatcagcgacaggcgctgctccagcagcaggatggtcagcccgtagtcgaggttaagccgacggatcagattgcccatctcctcttccagccacggcgacatcccgtcggtcggctcatccagaatcagcagtttgggctgcagcaccagcgcgcgcgccagggccagctgttgctgctgatcgatcggcagatcgccgctgcgctgctggcgcagagagtagagcgccgggaagaggtcgaacaccatttcgggaatggcgcgatggcggtcgcgctggctggcacccgccagcagggcaatcagcagattatcttccacgctcatctgggtaaaaatatggcggccctgcggcacatagccaatccccatctgcgcccgctgttcagccggttgcagcagcagatcttccggcggcgagccatcctctttccaggagatagagccgctgttaattggcaatctgcccatgatgcagtttaccagggtggttttacccatgccaggtcggcccagaatgccggtgcaggtaccaggcgacagatccaggtccacatcccacagaatatggttttgaccgtaaaattgatttaccgaacgtaaactcagcatctgacactctccttcccgatcgttagcctgattgcttccgcgctctgtcgtctggcaaacaagtcatcagcaacggcagcctcgccattgcagcacagtgcgcgtttcgcgcggtgacgccactgaactcctgcaattcccaggccagatctaaaaaaggccctgtttcctgccggagcgccacgtgtcagggaagaaaggtgagaaaaacttatcaattccccacggtgaccacgcacctgcacttttgcagtgccctggagcgctgtttctggtgcagaggtactgtaacgtggcaggaagtccgattaagaatcttagtatgaggcgtgcaaatttgcgtacggcacccggtgacagattaaaattgcagaataatcagtcagcaggcgacgcgaaatttaacgcaaaaaaaattattttcacggtagtgagaaggcagggaaaaattatacacagctgatggcgtcggggctgccatcacttatccaccattcctgtggataaccttgtgcattaggtaatgaaaaccagttggaagcgaggaaatacgcggcctggtaacataatgacgagaatctggcctcatagccttatgtcagtaaaatcagttgcttatcaaaaaacaagcctgagaattacctgtcaggtaaccgtactgtaattttgtgacactctattgacaaatgttaaatcagatccctgcctggggataacattgcgcatcatgctgagcgataacgctgccagcctgcagggacatcaggtgccatcctgctggcgttaacattgcaccaatactgtttttatatccagtattattttctggcaaaatcaccatagcagagtaaaataagtgcctgcccgccgacttctccagcaggaactgcattcatgagcaaagcctttaaattgaactccgcctttaaaccttcgggcgaccagcctgaggcgatacgtcgcctggaagaggggctggaggatggactggcccatcagaccttattaggcgtaaccggctccggtaaaacgtttaccgtcgccaacgtgattgccgacctcaaccggccgaccatggtactggcgccgaacaagacgctggccgcccagctctatggcgagatgaaagagtttttcccggataacgccgtcgagtttttcgtctcttactacgactactaccagcctgaagcctatgtgccgagctccgacacctttatcgaaaaggatgcgtcggtgaacgaacatatcgaacagatgcgtctgtcggccaccaaggcgctgctggaacggcgcgatgtcattgtggtggcgtcggtttcggctatctacggtctgggcgatcccgatctctatctgaaaatgatgctccaccttacccgcggcatgattatcgatcagcgcagtattctgcgccgtctgtcagagctgcaatacacccgcaacgaccaggcgtttccagcgcggcaccttccgggtgcgcggcgaagtgatcgatatcttcccggcggagtcagacgatattgcgctgcgcgtcgagctgtttgacgaagaggttgagcgtctgtcgctgtttgacccgctgaccggccagatcgattcggtcgtgccgcgctttaccatctaccccaagacgcactacgtcacgccgcgtgagcgtattctgcaggcgatggaagatatcaaagtcgagctggcggaccgccgccgggtgctgctggagaacaataagctgctggaagagcagcgcattacccagcgtacccagtttgacctggagatgatgagtgagctgggttactgctctggcattgagaactactcacgctacctctccgcacgcggaccgggcgaagcgccgccgacgctgtttgactatctgcccgccgatggcctgctggtggtggatgagtcgcacgtgaccattccgcagattggcggcatgtacaaaggcgaccgggcgcgtaaagagacgctggtggagtacggcttccgcctgccgtcggcgctggataaccgtccgatgaagtttgaagagtttgaggcgctggccccgcagaccatctatgtttcggcgacgccgggcaaatatgagctggaaaagtcgggcgacgaagtgatcgatcaggtggtgcgtcctaccggtctgctggatccgatcatcgaagtgcgtccggtcggtacccaggtcgacgatctgctgtcagaaatccgtcagcgcgtggcgatcaacgaacgtgtactggtgacggtgctgaccaaacgcatggcggaagatctcaccgaatatctgtctgagcatggtgagaaggtgcgttatctgcactccgatatcgacacggtagagcgtatggagattatccgcgacttacgtctgggcgagtttgatgtgctggtgggcattaacttactgcgtgaggggctggatatgccggaagtgtcgctggtggcgattctcgatgcggataaagagggcttcctgcgctccgaaacgctcgctgattcagaccattggccgtgcggcgcgtaacatcaacggtaaggcgattctctacggggataaaatcacgccgtcgatggcgcgcgccattgaagagaccgagcgccgccgtgagaaacagcagctgcacaacgaagagaatggcatcgtgccgcagggcctgaataagaagatcaccgatattctggaactgggcaaaaacgtggtgaaaacccgcggcaaagcgaaaccagcccgtcctggcgaagcccaggcgctggccgatttccagctgttaacgccgcaggctctgcagaagaagatccacgagctggaagggcagatgcagcagcatgctcagaacctggagttcgaacaggcggccaacgtgcgcgatcagctgcatgaactgcgaacgctgtttattgcggcctcgtagcgccgttaaagccctgaatggcgtgttccagcgccacccgtaacagctggcggtcgtgacgatattggatatcggcggcctccagcggttcacggacaatcagccggttttcaatgccacgggtgtccaccgccgggctgacgaccagcgcatcaatcacccgcttgccgatataacgctccatcatctgcagcttatcagccactgagaggctggcggcggcaggactcagctcgcggcccagattgccgataaacaccatggtggcaggcgtgcgacgcaaggcctgtgccatctcttccatcagcagaatcggcatcagactggtgtaaaagctgccgggtccaatcaggatcagatccgcttcaccaaccgcctgcagcgcttcccgcgttggctggacgttgggatgcagcatcagctcctgcggcggctgcttcatctcgtcaattgcggtttcgccataaaccatgttgccttcaacatccatcgccaccagatccaccggctgctccgacatcgggattaaaaaggcgtcgaccttcagcaggttacggatgatgttgatcgcttccagcggacgaacgctgagatgatccagcgcccgcagcatcagattacccaggttgtgtccggccagttcgccattaccggcaaaacggtactcaaacatcgccgaagcgacgctgggttctgcaatcagctggttaaggcagttacgcatatcgccccaggcgataccaccttctgagcgacgaatacggccggttgatccgccgttgtcggtggtggtgacgatgccggtgagacgcgagcccagcggggaaagggcagacatgacgcggcctaaaccgtgtccgcctcccagtgccacaacgcgatcaagatcggccagtgtgcgattcatacttctccttaatatccgttcgcgtggcgtggctctaatcgctaagcccgcgcggatgacttacgtcaaaatctggatcgcattttaacgtatcctgtcgcgaaaatgcggtgaaaattcgatatgtataagaatatatagcgaaaacagcaaatggaagagtgacgaaaatcacgctaccatcatgcttaccgcgctgatcaacgggtcagcgtacactcaagcctgaatgcctacgtctgcggatagggggttcaggccgtagccatcgagctgccagggtgcaggaagaaatgactgcatctcccaatctggaaaggtgttctggtgtcacaatttactgatgcatacgcgcgtaagttctattacctgcgcctgtcggtcacggatgtctgtaatttccgctgtacctactgtcttcctgacggctacaaaccgcagggaattcgtaacaaaagctttctctcgctggatgaaatccgccgcgtcacgcgggcctttgccgctgccggaacggaaaaagtgcggctgactggcggtgagccgtcgctgcgccgcgatttcaccgacatcattgcggcggtgcgcgaaaacgcctccattcgccagatcgcggtaaccaccaatggctaccggctggcgcgtgacgtgaaacagtggcgtgacgcggggttaaccgcactcaacgtcagcgtcgacagcctggatgcccgtcagtttcacgccattaccggccaggataaattccatcaggtgatgagtggtattgatgctgccctcgacgccggctttcgccaggtcaaagtcaacagcgtgctgatgcgcgatctcaacagccgtaatctggctacgttcctcgactggatccgcacccgtccgattcagctgcgctttatcgaactgatggagaccggcgacggcggcacgctattccgcgaccagcacgtttccggcatggtcatccgcgatcagctgattgcccaaggctggcagcgtcgggagagcggacgcagcgacggcccggcgcaggtcttttaccatcccgattatgtcggcgagattggtctgatcatgccttatgccaaagatttctgtgccagctgtaaccgtctgcgcgtttcggcgcacggtaatctgcatctatgcctgtttggtgacggcggtgtgccgctgcgcgatctgctggcgtcagacgaccagcaggccgaaactgcaggcgcgcatcgccagcagcctggggcagaaaaagcagacgcactttctgcatcagggcaacaccggcatcacacagaatctctcttacattggcggctaatttcaggaggcagtatgggtaaaccagccagcgaatttcaggcagtgcagattgcggtgatgaccgtgtcagatcgtcgcgatgccagtgacgatacctccggcgactatctgcgcgaagccgcagccgaagcggggcatgaggtggtcgatcacgctatcgtgccggataatctctatcgtattcgcgccaccgtgtcgcgctggatcgccagtgaagatgttcaggtcgtgattattaatggcggaaccggctttaacctgaaaaacagcacgccggaagcgctgctgccgctgttcgaccgcgagattgatggatttggcgaactgttccggatgatctcctatgaagagattggcggttcgacattgcagtcgcgcgcgattgccggtctggctaatcagacgctgatcctggccgtgccgggttccaccagcgcctgccgcaccgcctgggaacgcattatcgctgatcagcttgatgcgcgcaccgtgccctgtaattttgtctcacatctcaagaaacggtaagtatgtctcaactcacacacattaacgccgcgggcgaagcgcacatggtggatgtctccgccaaggcggaaaccgtgcgcgaagcgcgggcagaagtgctggtgctgatgcagccggaaacgctgcagatgattatcgaaggcagccaccataaaggggatgtctttgccaccgcgcgcatcgccggtattcaggcggcgaaacgcacctgggaactgattccgctctgtcatccgctgatgctgagcaaagtggaagtgaacctggaggctgaaccggaccacagccgggtccgcatcaccacgctctgtcgcctgaccggcaaaaccggcgtggagatggaagctctgacggccgcgtctgttgccgcgctcaccatctacgacatgtgcaaagcggtgcagaaagatatcgttatcgatcagctgcggttaatcagcaagagcggtggtaaaagcggcgatttccaggcggtcgcgcatgattaaggtgctgtttttcgcccaggtccgtgagctgaccggcacctcatcgcttgaggtcggtgctgattatccggatgtggccgcgctgcgcagtgcgctggcagaacgcgatgaccgctgggcgctggcgctcgagtcgggcaagctgctggcggcggtgaatcagacgctggtgccgatgagtcatccgctgcacgccggtgatgaagtggccttcttcccgcccgtgaccggaggctaagatggaaacgcagattcgcgtcggccccgcgccctttgatatggcggaagcgtatcgctggctggcggcctgtgatgaagatggtgctgtagtgacctttaccggcaaagtccgtaaccacaatctgggcaacgacgtcgcggcactgacgctggagcactatcccggcatgaccgaaaaagcgctgcaggagattgttgatgcggcgcgcgaaacgctggccgctgcagcgcgtcacggtgatccatcgcgtgggcgaactgtttcccggcgatgaaatcgtgctggtgggcgtgaccagcgcccatcgcggcagcgccttttccgctgccgagttcattatggattacctgaaaacccgcgcgccgttctggaagcgagaagcgacagagcagggcgatcgctgggtggatgcccgcgacagcgaccaccaggcggctcagcgctgggactaagctgcattaacggcttagcgggcagaagtgtctgcgcccgctgagccgttaaccgcagacacgccgctgcccgcatcaccaggcatcacgacgcttagcgcggaattaaggctgctttagctgctcagccggaccaaaaccggtctgaccatggctgtgttcgccgccgccggcggtgcgcttcagctgaatgacctggccctgttgccaggcattggcacctgccgcggcaggatgcgccacgatatccgcacgctgggcgcggatctttttgctgtcgacgtcaaaacgacgatcgcggtccgccagcagtcgcgagtccatctgtccatcctccgtaaagcccatcatcagcgccggaatgccgatcggcagcgttttgtcgcgatcggtgtgccaggtgtgccaggttttcccgtaggtgttcacaatgcgcttcatcagggcgtggtcggcggcttccggtaagcctggggcaatcagcgtgcccgatttcacctcatactgatggctgtgccagagcttcttctcttcgggcggcagggtgttaaacagccgttcgctgataatgtactccacgcccatcagccgtgcgtcgcgcgtgttgccgtcgtaaatcaccgcctgcatcacatcgtcgttcagcacggtgacatagtggtgcgcctccatctgaccgttcttatcgccgttataaaaatggaatccgtcgagataggtgttgatggcgtcgatgggcggacgtgactgcatcacgctggcgccggtctccagcaccttaagcgaggaggaggtgggggcgcccggagattttacctgggcaggcgtattattagcgccgcagccggttaataacaggctgaacgccgcaacaggccagagtttaaacatcgtaagttcctttaacggtaaaaaagataaccttagttcagttctcgcctgcctgtgaaactctggcgatggtagagtagagctttggttcattctgaggacaggcatgtcatccaccccgattctgcaacgtctgacactggtcgccgcactggtgctggcaggttgtagcagcaagaaaacccctgaggcgccggtgcggcagcctgaagatgtcaaagcgcagatccagcggctgttgccgtcgcacgtcagcaataaagcggcatggagcgacgatatctacaccaccttccgcactcagcagatcgatcccagcgccagcaacctctgcgcggtgatcgccgtggcggatcaggagagcaacttcagcgccgaggccgccgtgccgggtctgccaaaaatcgcctggggcgagatcaaccgccgtgcggcgcaggtgcatgtcccggcattcctggtgcgtaccgcgctgcagatcaaatcgcccaccggtgaaagctacgccgcccggctggacaaagtgcgcagtgagaaagagctgagcgctattttcgatgacctgatcgatatggtgccgatgggccagacgctgttcggcaatctcaatccaatccacaccggcgggccgatgcaggtcagcattgcgtttgccgaagcgcatgccaaaggctacccgtggccgattgatggcaccatccggcgtgaagtctttacccgccacggcgggatctacttcgggacgatgcacctgctcggctatccggctgactacagccagccgctctaccgctttgccgactacaatgcgggctggtatgccagccgcaatgcggccttccaggcggcggtgtcgcgcgccaccggcatgaagctggcgctggatggcgatctgattctttatggatcggatgcggcgggcggcaccgaactggcggtgcgcacgctgtcgaagcagatcgatatgagcaacagcgacattcgccgcgatctggagaaaggggagaaagcgtcgttcagcgacagcgaaactctggaaacaggtctttaccctggcggataaaatggcgggtcgaaagttaccgcgtgaaatgctgccgggcatcaagctggaaagcccgaaaattacccgtaatctcaccacggcgtggtttgcgcagcgtgtcgacagccgttatcagcagtgcctgtcgcgacgttaagcggcatgttgtggcgcagttgagctgagctgtgccacacttagagccagttccgggcgacttttattgttattctggccctgaactgtgcgcatcctcataaggccgtatgggcccgtggcggttgtgtcgcgctgtcgctggcccaacgggctgaaacagaaacaacgtatgcctgccagaccaggttattcatccggttccctgtgtggagccggtcctaatccgtttaacaagaggtgcatcatggaccgatatccacgaaatgattccatcgttcaatccgcatctcgcggtttacaagcctatatggcgcaggtttatggctggatgacctgcggtctgttactgacggcgtttgtctcctggtacgctgcgcgcacgccagcgatcatggagctggtatttgctaaccgcatcaccttcttcgggctgattatcgtgcagctggggctggtcttcttcctgtcaggcatggtgcatcgcctgagcggggccgtggcaaccgggctgtttatgctctattcggcgctgaccggcctgaccatggcgagtatctttctggtttacaccaactcctcgatcgccagcaccttctttatcacggcggggatgtttggcgcgatgagcttctacggctataccaccaaacgcgatctcagccgttttggcagtctgctgtttatggcgctgattggcatcgtgctggcgtcgctggtgaacttctggctgaaaagcccggcgctgatgtgggcgattacctacatcggggtggtggtatttgtggggttaacggcctatgacacgcagaagctgaaaaatatcggtgagcagatcgatgcccgcgatacggaaaacctgcgtcgctactcgattatgggcgcactgacgctgtatctcgactttatcaacctgttcctgatgctgctgcggattttcggcaaccgccgttaagcctgagggagtagcgggggaggcgcactgtctgcgcctccccttttttattacgacttctgcaacttctgctcgttcttctgacgcagatgcttcgcccgactctccagccccagatagagcaccagcgctaacagcagcggcaggataaagtagagcacgcgataagccagcagcgccgcaatgatagtgccatgcgaggcgtgctgaccgctgagtaacgccaggaagaccgcttccagtacgccaatgcccgcaggaatatgaatgattaccccggcaatactgctgatcagcagcacgcccagcaccatcggataaccgacgtctcgtcccagcagcagccagataatcgcccccatcaccatccagttggcacaggaaaccgcaaactgcagcagcgccatgcgcagcgagggcagctgcagcgtctggccttttaccgtccagcgacgctgctttgagaaggcacaggcccagaggtagaccgccaccagcaccagcagagcgccaccaatcagccgcagggtggtttcaccaataaaccagccgctgggaatcgacaccatgcccgcactgaataccacgcccgccagcagaatatagcccagccagttagtggcgatgctcagagagaagatgcgggtaatggtgccgctatccagccctaaccgtgaatagagccggtagcgcatcgcgacgccacccacccaggtgctcagcgtcaggttgaaggcgtaacagataaacgacaccagcatcacctgccgcttcgccagcttatggccgcagtaggcgcgtccaatcaggtcatagcagccatacaccaggtaactcagcaccaccagtccggcggcggtcagtaccacaaagcggttgtagttaacgatgacgtcataaacatcttcccagttcactttgcgggcatagaccaccagcagaaccaccaccgcgatgaaaaagagcacggtgaggatttttttcgccagttgccagcgtggatgtttttttgccatcaggattttgctcccgggttatcagtttcaacgcgatcctgcgtctccatttcaggctgtaccggctcgcccacctgggccagcagcggcgtatgcgccggcagccagccagcgatggccgggaaatggcgcaggaagtggaataccaccacgcttttactcagttgccaccagttgcgcggcggtaagcgatcttcctgcacgcgctggcaatcgttggccagcagcgcttccaggttatcacgcagcgtctggttaaacggtctgtcgtggatgatcagattggcttcaaggttaagtgacaggctgagcggatcgagattgctggagccgacggtggcccagtagtcgtcttttaccgcgatcttgccgtgcagcgggcgacggatatattcgtagacttcaacgccgccatcgaccagatagttgtagagcagctccgcgcccactttcacaatcggcatatctggttcgccctgcacaatcagtcgtacccggacgccacgctgcgcggcgttgcgcatctcacgcagcagccggtaacccgggaagaagtaggcattggcgataatcacatcccgcttcgcctcacgcagcatctcaaggtagtggacttcgatgtcgtcacgatgctcgtcgttatcgcgataaatatagagcacctgagcatcgccgggcgtggcgttgaccgccggacgatgagagcgcgatccccaccagcggcgggtattctgttcgctgccaatcgcctgttgcagatagcgggcgatgtcacccaccaccgggcctttgacctgcaccgcataatcctgtttcgcttccgggccataatccgtgttgtgctcggccgagaagttaatgccgcccacaaaggctaccacgtcatccaccaccacggttttgcggtgcaggcggcggaaaacgttggtgcgcatccccatcaccagcggacgcggatcgtaatagatgaaacgcacgccagcgctggtcaggctgttaacaaatttgtcggagagttcggcagagccataaccatcgaccatcacttcgacccgcacgccgcgctgggctgccgccagcagttcgcggtgcagggcgttgcccacgtcatcctcaaacagaataaaggtttcgattaataccgtacgttccgcccgctggatcgcgccaaagacccgcgggaaaaacgcttcgccattttccagcaacagcagccggttgccttcctgccagctaaaattcataggtgaatctccaccgccagcggcgcatggtcggaaagatgggaccagggcttgcgcggcagcgcccacggatgactgacggtggcgttgcggacatagatgcggtcaagccgcaggatcgggaagcgcgccgggaaggtgcgcgccgggcgtccggttttcatgctgaatacctctttcaggcctgcgccatgtttcagaatggaattggcgcgtcgctgccagtcgttgaaatcgcccgccaccaccaccggcgcgtcgggcggcagtgagttaaccatttcacatattttcttcatctgcgcgtgacgatgggccactttcagacccagatgaacgcagatgacatgcagcgtgccgtgcggctcgggcagggcgatctggcagtgcagcataccgcggttttcactgcccgccaccgagatatcccggttctcatagtcggcgatcgggaagcgagacagcaccgcattgccgtgatgcccctccggatagaccgcattacgcccataggcgaaatcgttccatatggtgtcggccagaaactcataatgaggagaatcgggccactcttcatggttaagggagtggatggcatgcgtgcccatcacctcctgcagaaagaccacatccgcctccgttgcgcgaacggcgtcgcgtaattcgggcaggatgaagcggcgattgaaaggggcgaaacccttatgtgtattgatcgtcaggacttttattgaaaatccttgcttgttttgtggcatactcgcgacgcactccttttcatcatcaatagaatcaaagtgtagtctttgtcacaaatgggtggtgaaagagggcgaaaattagggcgttatccgaaaattgttttacattgaggaaatcgtttccggcttgtgccggtagcacttgggcgacctgttgggtctgccaggagaactgaatgaaatggtctaatcgtattcaaattatcacgggtcaaacgttgttgcatattgctatgcatctgctggtgatcgctgcactgatctggggctggaagcacaaagcgctggttgatgtctgcagtacgctggtggcgatgtacgcactggtttttgttgccatgctggtgacacagcgcattgcccgtttacgtactctcggcgattatcttgaagaagcgaccaccacttactactttggcgccgccatgatgacactgtttcctggtgtcgcggatttaccacaacaacctgctgctggcgtgtctcggcgtagtgatgttgctgggtccggcgctggtctcgctgctggcgaaagagccaccgcgacgaatcgaaaacaaacgtagttaagttgaaggccaccggaaggtggccttcctgttttcaggcggttaagttgtgtcaggaaatgtgagctatctcgcacacttctcttaaagctgttacactcgcccgcttacgcatcgtagtttgcgcccttttcacgcgtcagccctggctggcgtcactatccctctgaaaactacaccgtgaatcacggtcagagcggaccggagtaaatcacttaatgtcttttgactctctcggcctgagtgccgatattttgcgcgcggtcgccgaacaaggctacagcgaacccacacctatccagcgccaggcgattcctgttgtgctggcaggccgcgatctgctggcgagcgcccagaccggcaccggcaaaacagccggctttaccttaccgatgttacaaaaactctctgccactgccacgcccatccgcggtcgtcgcccggtgcgcgccctgatcctgaccccaacccgtgagctcgcggcgcaggtcggcgaaaacgtcagcgactacagcaaatatctctcgctgcgttccatggtggtgtttggtggcgtcagcatcaatccacagatggtcaaactgcgtggcggcgtcgatattttggtggcaacgcctggacgcctgctggatctggcacaacagaatgcggttgacctgtcacaggtcgaaattctggtgctggatgaagcggaccgtatgctggatatgggctttatccacgacatccgtcgcgtactggcgcgtctgccggctaaacgtcagaacctgctgttctctgccaccttctctgatgagatcaaaggcctggctgaaaaactgctgaccaacccggaaatgattgaagtggctcgccgcaacaccgcctccgagcaggtcgcgcagcaggtggctttcgttgataagaagcgtaagcgtgaattgttgtcgcagctgattggcgaaggcaactggcagcaggtgctggtcttcacccggaccaaacacggcgcgaaccaccttgccgagcagctgggcaaagatggcatctccgccgccgcgatccacggcaacaagagccagggtgcacgtacccgcgcgctggccgactttaagtcaggcggaattcgcgtcctggttgccaccgatatcgcggcccgtggcctggatatcgaagagctgccacacgtcgtgaactatgagctgcctaacgtcgccgaagattacgttcaccgtattggccgtaccggccgtgcggcggcgaccggtgtcgcactgtcactggtctgcgtcgatgagcataaactgctgcgtgatatcgaacgtctgctgaagcgtgaaatcccgcgtctggccgttgaaggttatgaacccgatccgagcatcaaagcggagccgatcatcaacggtcgtcagcagcagtctcgcggcggtgcaggtggcggtggcggcggccgtggtcgcagccagggcggacagggtgcaggcgcatcgcgctcatcttcatccggcgaaaagcgtcctcaggcgcgtcgtcagagccaggccgctcctcagggcgataggcccgcagcccgtccgcgtcgtccggcagcagcgaagcgtaccggaaacgtctgagtatgagggttttactggcaccgatggagggcgtgctggattcactggtgcgccagctgttatcggaagtgaacgactacgatctctgcatcactgagtttttgcgcgtggtcgatcaactgctgccggtaaaatctttctaccgtctctgccccgaactgcataacgccagccgcacgccttccggcacgcgggtgcgtatgcagctgctggggcagcatcccgaatggttagccgagaaacgccgcacgtgcggtggagctgggctcatggggtgtggatctcaactgtggttgtccttctaaactggtcaacggcagcggaggcggcgcaactcttcttaaagatcccgatctgatctatcgcggcgcgaaagcgatgcgtgaagcggtgcctgcagatttgccggtaacggtgaaagtgcggctcggctgggactccagcgcccgcagtctggagattgccgatgcggtgcaacaggccggtgccagcgagctggcggtgcatgggcggactaaagaagagggctatcgcgcagaggcgatcaactggcaggcgattggcgacattcgtcagcggctgcgcattccggtgattgctaatggcgaaatctgggactggcaaagcgcgcaacactgtatggcggtaaccggctgcgatgcggtgatgattggccgtggcgcactgaacatccccaacctgagccgggtagtgaaatataacgaaccaccgatggcctggcctgatgtggtgcggttattacagaaatacagccggctggaaaagcagggcgataccggcctctaccacgtggcgcgtatcaaacagtggctcggttatctgcgcaaagcctatggcgaagccgatggcttattcagcgaaatccgtgcgttaaaatcgtcgggcgacattgcacaggcgattgatcgtcacgcacatgttcatggtttgtgataaaaaatcaggcgaccccttagcggcctgacggtatagtgggaaaaatttcctggaccccttgcctgctatgtctgactccgctgtgttgagcaacagccagctcaacaaacgaatcctctccgttattatcttcaccttcttctgctatctctctgtcggactgccgctggccgtgctgccaggcttcgtcaaaaatcatcttggcttcagctcctttatcgccggactgattatcagcattcaatattttgcgacgctgctcagccgtccgcagtcgggccgtctggccgatcgccttgggccaaagcgggtggtgatgctgggactgctctgctgcggcatgagcggggtgctgactatcgtggccgcactgctgagcggctggccatggctgagtctggcgctgctggccatcgggcggctgtttctcggcgtaggtgaaagcttcagcagcaccggctctaccctgtggggtatgaacatcgtcgggccaatgcagaccgcgcgcgtgatctcctggaacggtgttgcgacctatctggcaatggccgtcggtgcaccgctgggtgtgctgctgaacagtgaatttggtatgagtggatttgccgggctgattgcgctgatgggcgtggcgggctatctgatggccagtcgcaaaccggcggtgacggtcagcgtgggcgagcgcattccgtttcaccgcgtcttctcccgcgtctggctctatggcctggcgctgggcttcggcaccatcggttttggcgttatcgccacctttatcaccctctattttgccagccgtgactggcagggcgcggcctatgcgctgacgctgttcagcctggggtttgtgctggtgcgactgggttttggtcgctttattacccgtttcggcgggctgcgcgtgtcgctcttctcattcctgctggaatgtctgggactgctgattatctggcaggcggacagcgcctggctggtaggggcgggcgcattcctcaccggtagcggattttcgctggtctttccggcgctgggcgttgaggcggttaaacgggttgagcgccaggatcagggctcggcgctgggcacctattccgcttttctcgatctgggcctgggtttaaccggcccggtggcgggattgcttatcggacactgggggatgcagtcagtctatctggcggcggcgttgatggtgctgggggcgctgctgattaccctgcggctttactggcagcagcggcttatcgcctgaatgacgataagccgcagaccgttaaaaatggctgaacgcccagtagagcagggcagagagcagaatagataccggcagcgttaaaatccaggcgacggccaggttacgcagcgtcgagagctgcaagccggaacggttcgccgccatagtgcccgccacgccggatgagagcacgtgagtggtggaaaccggtaaaccgaaaccgtctgccgcgccaatggtcatcatcgccaccagttcggcgctggcgccctgagcatagctcagatgggttttaccgattcgttctcccactgtgaccacaatccggcgccagccgaccatggtgcccagtcccagcgcaatcgccaccaccactttcacccacatcggaataaaacgggtggcgctgtcgagttccgttttcactgccttgagattgcgttccgtctcctgcggcagtctgacctcggcgctctgcagatgcttgatcgattctgacgccagatacatctggttgcgggtattggtcaccgcctgagctggaatgttttccattgaaccgtaacgacgaatctcatcgccgacttcgcgcagcgtcatcgccagcgcgggcagcacgtcgggattcatgctgttgctgccaacaaagccggtcagtacctcacgggccggtggaggattggctgacgcgggctgcagttgcagcagctgatgggcggtcacttcgttcagcgccgcgacgcgcgggatctgatcgggtggcagcgatcggttcagggcgtaggcgatcggcatggtgcccaccaggatcagcataatcagccccatccctttctgaccatcgttggagccgtgcgcaaacgacacgccggtacaggtcaggatcagcaggccgcggatccagaccggtggcggctgattgctttccggcgcctgataaagctggcgattgcggataaacagtttcatcacccacagcagcagcccggcgcagacaaagccgaccaccggtgatagcagcagtgcatagccgaccttcaaggcctgatcccagtcaactccgctcagaccgctgcgtccgtgcagcatcgcattggcaacgccgacgccgatgatcgagccgatcagcgtatgggacgacgacgacggcagccctaaataccaggtgcccaggttccagataatcgctgagaagagcagcgcatagaccatggcaaacccgctgccgctgctggcctgcaggatcaactccaccggcagcagtgagataatgccaaacgccaccacgccgctggagagcagcacacccagaaagttacagaaaccggaccagaccaccgcgacgccgggcgtcagcgaatgggtgtagatcacggtcgccacggcattggcggtatcgtgaaagccattcacgaactcaaagccgagcgcaatcagcagtgccagccccagcagaaagaacggcagatagctggtgaccggcatattggtctcttcaacatcgctgaccagattgaggccagcgaaacgccagtccggcaaccagcagaataaagaacagcggtttactgaaacggctatttttgccgttgaaatcggggcgacctcgggctgatgaggaggagagactgttttcgctcatggtgtacctctggtggctgatgccggatgctgatttgcaccgggtcaacgcagtgtgatacgcgctttatatgacagattaatgatcgtcggacggggcattctgagcggagtgcggggaaaaacgcagaaacgcaggcaataaaaaagccagcgacaggcgctggcttctgaaagcagggcggcaattacgagctggtattggccgcggctgcaggggctgctggtgttaccggagcggccggtgcggctggctcagtggccggctgctgtggctgcgcggcatcactgtttgcaccctgagaggtgactggcgtcattggctcttcctgtggcacagcctgcgggttttccggcatcggaactggcgcagtctggatgttgttctccacgccgttcacttttactggcataccggtacggccctgaatcgcgccattaacctgatcctgattgacgctggcatcaaccagaactttgctcaccgcctgattcagcgtaatcggcaccagctcacgcgagttgaactgctcttcggtggtcgacagcgggttatgcacttctacataccgtgaaccgtctggctccacggtcgcttttaccggctgatcaacaaactgtacgcgcgtgccgaccggcacgttctgatacagccatttgatatcgtcagcgcgcagacgcacacaaccatggctcacgcgcaggccgataccgaagttggcgttggtgccgtgaatcgcatagaggcgaccgatatagagcgcatacaggcccatcgggttatccgggcctggcgggaagaccgctggcagggtttcaccgcgcgccgcgtaatccgcatgcatgcctttggttggcgtccaggtcgggccatcttttttacgtttctaccgctgtggtccagttaatcggggtatctttacccagctcaccgataccaataggcaacaccaccacggttttgctgcctttcggatagtagtaaagacgcatctcagcgctgttaatcacaatgccttcacgcggtgcgtccggcaggatcagctgctgtgggatgatcattttgctgccagctttaggcagataaacgtcaacgcccggattggcttccagcatattgctgaggcccatctggtactgtgccgcaaaagcttccagcggcagtttgctgtcttcagggacagtaatttcgatattttcgccgatcagacgactgttggccggcggtaacgggtaaaccacagcaaaggctgactggctgaaggccgccagagccagtgcgattgaagcgaaagcgcgaatgattttcatattttacaattctttatcgccatatttcaggctgttcagtgtgtcgaattcatgctggccaatgtgacctgctgcgcattatatgttcattaatctgacgttgtgaatcgggattttaacctgcctgcaatactttacgtaaattcaccgcggatgttagcgcatttaccgaaagcagggcgctaaaaatggggctttccgggcttatcgctgactaaggttgccactgtgtttgttcgccgctgagtttgcggttcaggaaaaaggcggcactgattaacgccagatgggtcagcgcctgcggcgtgttgcccagcgcatggccgtggctgtcaaactcctccgcgtagaggcccagtggattggcgtagctcagcaacttttcaaattcaaaatgcgcttcctgaatccggcccgcgcgcgccagacactcgacataccagaaggagcaggctccgaacgacccttctgagcctttcaggccatcggcgggcgtttcatgcgtattgtaacggcgcaccataccgtcgctgaccagattggttttgatcgcatccagcgtggcaatccagtccgggtcggtggctcccacaaaacgcaccagcggcatcagcagcattgaggcgtcgagatgttcgccatgacgggtcgaagagaagtgaccccgctcactgttccagaagttagcccagatatcctcgcggatctcccggcgcgcccgatcccagcgttcataaggcatcggcagcgatcgcttcatgcccagacgcagcgcgcgatccatcgccacccagcacatcagacgcgagtgcaggaaatgttccggttcaccgcgcatctcccagataccggcatcgggctgatcccagttctcacacagccagtcgatcattttgacgacatgttcccagccgcgctgggagatcgcctcaccatatttattggccagatagaccgcatccatcagctcgccatagatatcgagctgtgtctgctgccaggcgtcattgccgatgcgcaccggacgggagtcggcatagccggagagattcagcagctccatctcgtgcagttcggtgccgctgtccagccggtacatgacctgcaggcgcatctcatcgtgatggctgttttcaacgcagcgaccaacccagtgggtaaagtgtttggcttcatcgatatagcccagacgcattagggcatacatgctgaacgaggcgtcacggatccaggaggcgcgatagtcccagttgcgttcaccgcccagctcttcgggcaggccaaaggtcgctgccgccgcaatagagccgtgctgatgtgaggtcagcagtttgaggaccagcgccgaacgctgcaccatttcgcgccagcgtccctgatagttactgtgggcgctccagcgtcgccagtagttcagcgtctcttcaaagcagtgttcggtggtcagggcttcgatatgcgcatcatccacgctgccaaattcaaactgcgcatgttcaccgggttgtaacgtgaagagggcagtcgcgctctcatcctccagcgtcatcgccacgctggcggcgaggcgcagcgacggctggccttcggcatgaaaatcgatacagccgttgtgcgcctctgcgcgggtctgcgcccgggcgtagtcgtggcgcggtgaacagcgcaggctaaaggtcgcgctgccgcgtaccattttgacccgccggatcagacgcggcagcttgtccttgtcatcacaaatcggcatgtagtcggtgatttccgctacgccttcatcatccagccagcgggtctgcaggatgttggtatcgggcaggtagagctgctgacgtcgcgcattgggccagtcaggggccagggagaaaagcccggcatcatcgctgtcgagcagggcggcaaagaccgacgggctgtcgagttccggccagcagagataatcaatggtgccatcattcgcgaccagtgcgcaggtgcgcaaatctccgatcacgccatggtcttcaatcttacgttttaccttactcatcctcatctccctgtcagtgtccatcctaactatagctgagccatctgatgcggcttcgtttgggcacagatggttaacgtacggttgaatgaggcagggaaggggggagggcgggtgagacatgggaaatcgccagcagggtcgcctggcgctgctcagcgtcggcgacccttaccaccggtcagctcactctcatagacgatggcgtctgctggcgaatccgtggttcatttattcctgatcggcacgacgattgtgccagcggcggatcacccagcgcagcgcaaaggcgaataccactgcgccgaccagccacagcagatgcttcagatgctggtcgagtttatgcagccatggcgcgatgatgccgcccgcgaaatagcccagggtgacgaagatcagcgcccagatgaccgccccgatgacgttaagaataaaaaatttcatcggattgaggcggctggccccgatgatgattgggccaatcagtcgaaagccatacataaagcgcacgccaatcacaaacaggctgggacggcgtttaatcaggcggttcgccttgaccactttatcctgatgctttttaaagcggcgcaggatctgtgtgccccagcggcgaccgacccagtagagcagttgatcgccgacaataccgccacccattgcggccagcaccactcccacgtaatgcagcagcccctcatgcgcggcgacgccgcccagcaacgtaaatgtttccccctcggcgatacagccaataaaaagtgccagataaccgtactgcgtaattaatgcgttgatatccagatgcaaaatgaccctccctgttcagtgactgtttcttccagtctatacgcgatttggcttcgcttccgcccgtgcctcatgggtccgtttatttatgctgtttttttgtccgatcaccacgaaagtttcgctgccatttatacttgagaggacgctgcccccaaagacggatgcatcatcgggcggcccactgcatcagaggagtgaatctatgaatcatgtctggggtctgctggcgcatccgaatcaggaaatgcgtcatatcaagcaagagaatgagagcgtatcgcaccattacacccaccatgttctgctgatggcggcgattccggtgatctgcgcctttatcggcacaactcagctgggctggaatctgggcgaggggcaatatgtgcaactcaacctgttgaccgggattgggcttggcattctgttctatctgattattctgggtggcgtcgcggtaatgggacgcgtgattcactggatggcacgtgattatccgcagcgccccggcgtacagcgctgtacggtgtttgcgggctatgtggccacgccgctgtttctcagcgggctggtggcactctatccgctggtctggctctgcgtgctggcgggcgccctggcgctgctctacaccggctatctgctctatatcggtattccactgtttcttaatatcgaccgcgaagagagtttgcgcttttccggttcaacgctggccatcggcgtgctggtatttgaagtattactggcattaaccgtggtgctgtggggatatggaccgcatctgttctgacagctcgctgccgccgctctggcggcagttctctttttacgcccggaaacactctcaccaggaaatttcttaaccttacgggtatgatatcgccgccagcccgcgctccgacctcactgaagcgggcggcctgtgtcggtctgacacagtacatattcataaccgggttttttctacgatgcctgcaaaaattcgttctaccctgctttcgctggcgctgctcgtttcagggcagattgtttcacttccggcgcaggcgacgacgtcgctgtcgcaactggcgccgattgctcagccgcagatcgcctctggcagtgcgatgattgtcgatctcacgactaataaagtgctgttttccagccaccctgatcgggtcaggcccattgcctccatcaccaagctgatgaccgcaatggtggtgctggatgcgcatctgccgatgaacgagatgataaccgtcgatgtcagccagacgccggaaatgcggggtgtcttttcacgcgttaagctcaacagccagatcagccgccggaatatgctgctgctggcgctgatgtcctcggaaaaccgcgccgccgccagcctggctcatgcttatccgggcggctataacgcctttatccgggcgatgaacgcgaaagcgcggtcactgggcatgaaacagacccgctatgtggagccaaccggcctgtcgaggcaaaacgtctccagcgcgcaggatctggttaaactactcaaagcgacgcgggaatatccgctgcttggcgcgctcagcaccactaaagaggagacggcagtgttcgcccatccgagctatgcgctgccgttccgcaacaccaaccatctggtctataaagatgactggcatattcagctaaccaaaaccggttacaccgatgaggcgggacactgcctggtgatgcgcaccatgattaataatcgtccggtggcgctggtggtgctggatgcctttggcaaatatacccacttcgccgacgctaaccgtctgcgcagctggattgagaccggtaaagcggcgccggtgccggctgccgcactggcctataaaaaacagaagtcgggccaggttgccagtaatggggccagcagcgccgacgttgagtagaatatagccggtgttgcgcgctgcggacactggcattacctgcaggctgagcgggtatccgggatgatgctggcagaggcgtacagcgattttcacgcttatgtctgcaccgaattagcccgaaaaatgcccgttattcctatattgccatcccttgtaaagccctacactacgcgcgactggcgagggaagatcgcctgatttaagctgccggaatcttactcatatgtttaagctacgatccttttttgcattgttaatgctggcgctggtggcgtttgccccggcgctgacgctggccgcggatgataaggccactgctgctcaggaacaggatgctccgccgaagctgaatgctgcggttgaactgccgaaaatgcagaagatcctcgataaaatcaaaagtcaggtctccgttgatgctggcgaaaacaagctgactcagctgaatgaaatggcgcttgagctctcaggcagtgccgacacgctgggccaggcgctgctccccgatcgccagcaactggaagcccagttgcaggttctggggccggcacctaaagccgacagcggcgtaaaagagacgtcggaagtgacgcgcaagcgtaacgcgctggagagtcagaaaagcaaactcgacgatcagattaaacaggccgaaggcattaaaaatggcgcgctgatgctctcctcgcagattgttaacctgcgccgcgatcagctgaaaagccagctggcgctgaactccggcaccattctggggccgcgcttctggtcaccactgctcaatagtcaggatctggatggcgagaaaattggtgaattcctgcaggagttgcaggacaccgcggcactctcatgggagccgggctggcgcgtgggcagtgttttctggctgctggctgccatgctggtgatgacggctggccgtcgttacagcgaagagtttctggcctggatcagcattcacaaactgccggaagggaagctgcgccgcagtttcctggcggcagcgatagccctgaccaccctggtggctgtcgtcctcacctttaactttatcgccctggcctttacccgccgtgatgaggtttctgaaaacgttcaggactttgtggatcaactggttcggctcagtgtcttttgtggcctgattgccggactgggacgcgctttcctctctacccgtcgacccagctggcgtttaccgaccatctccaatgaagtggcgatggcgttaaaaccgtttccaccgattaccgccgtgctggtctttatcttccagacggtcgaagcgtttaactacagcgtcggcaccagcctgaataccaccatttttgccaacgggctgacggcactgctgattggtactaccgcgctggcgatcagcatgcgcaccaaccgcgttcgtcgccgtatgacccaggcgggtacaccaccggaggcccgttctacgctggtcggactgatccagatgggtctgacgctgaccggcatcgctattctggtgtcgctgctcatcggttacgtcacgctggcgcgcttcctgagttatgaagtgatctggtgcggcctgctgtttggttcgttctacttcctcagtcatctgctcaacgatggctgtgagagcctgttctcgaccagtaacgcaaccggtcgccgtattcagagttcgcttaacatcaatgagcgccatctgcagcaaacggctacgttgctgacggccatcggtaaaaccttcctggtgctggttgtggcgctggcgctggtcaacgggacctttgcctcttcaacgccgattgagctgctgcaaaaagtgattgagttctggggcggtaaagggcttgaatccctgaatatcgtcccggcgcatatggtgaatgcgataatctgcctgatcgtcggcatctatgtgctgcgaacggtgcgccgctggctcgacaccgattttctgccgaaaaccaccatggatgtgggcatgcgggtgtcgctggtgacgctgttcagcaacatcggttatgtactggtcatcctgctgacgttgtctatcatgggtctgcagtggaataagctggcctggatcgtcagtgccttgtcggtaggtatcggttttggcttacaggagattgtgaagaactttatctcggggctgattctgttgaccgagcggccagtgaaggttggcgatctggtgagcatcagcggtatcgaaggggatatccgccggattaacgtgcgcgctaccgagatccagctgggcgataaatccacggtgattgtgccgaactcgcagtttatctcgcagaacgtgcgaaatgccaccatgggtaatgcgcagggggtggtcacgattacgctgacgttcccgctcgacatcgatccggcgaaagtgcgcgatatcctgctggaagtctacaacgaaaatgaacgcattctggagacgccagagccatccgtttcgtttaaagatctgactcagcagggaattatactgagcgtcaccggtaacgtggcgggtcagcgccagatcgcaggggcgaagagcgatctgctgttcgatattctgacgcgtctgcgtaaagagggcattctgctttccacaccgcaaaccatgattatcgagcgccgtcagcagatggcgggtgcggagccggtccccgaagagaagctggtttaggtgtgaaagggccgacttctgtctaatgctgatcagttaagatcagatttgtaaaggctgccacggtcaaacgtggcagccttttttctgggcgagcgagcagcagcggcgctcaggccttcactatcgtgccctttttaacaatacacactgaagtttcagagcaggccggggccgggcaggggcaggtaatccgcagcgctgaacagaatgagtctgccaggagagcccgcaggacgcgggcgaaaggcggggcggcacaggatgtgccatccccggcggtccgtcaggcaggcgaatgaagtgaaggaaaccgcgcagcggcgcgaggaccgccagcccctgcccggcaccagactgcgttatcccctgtcgcttaactgactgccattagacttctgtcggcctttttcatattcaaacgctggcttctcagcccgttcacacttcgctttctacagggattcaacgcggctggtgtgctgcccgtctcggctcaccgagcgaattgccaccgcaccgctgacctgcggcggtctggtggcatcgtagcgctgccagtttgtgcccttgtccaggctgtactccagcgtaacgcccggtaaggccacgttcatcgacaggatgccatcaacgattctggctcccggcaccggcaggcgataatcgatacccgccttatccagcttcgccagttcccgctgtcccagcagattggcaaatcgctgccagtcattcaggcgtgcctgcagatcgacgagatgggttttaccccccgcatactcctgacccgccttgtaatcctgctcccagctggcgcggtgccagcttcgttccgctaccgcaaacaggcgaggatagatcatgtgctccatttgagcatcagtgcgtaccgtttcgctccacagctgggccgaaatgccgtaagcaccgctccagggcttctctgatttggcgctgaaaaagttgccgtcgcgatccaccgaggtttcagcattctgcggcaggttgtccggcgcgaagccaaagattttgcgctcgtcgttgaagcgcgtgccccagtaatagccgcgctccagtgggttaacttcatacggaaaatccagatagagatagtcggggctggagatcaccacgtcgtagcctttctgtgaccagtcactggcactgtcaaaaccgccccagtagagggtgtcccagaagttgaccgcgacgcgcggtgtggcaaaggctgctgaatctttggcattttttaaaccatcctgccaggcctgcattttgccaataccgtgccggttaacgatgtcactaacggtcagggcaaaatagctcggcaggtgcgccagatcgtctactttgccgctcttcaccagcgcctgacaaacctgcgatttcgcccacggcaggtcttctttactccagtcgcgcagaccggtgcccggtttagggtcgcgtttatccgagtagccagcacccagccggatattcttcgcttcgtcaccgccaaaatgccagacgccgagcggctgtcccgcttcccggtgcatcgcctgaacttcaccgatcactttatcgacaaaccgctgtgaacccgcaatgcagggattgagatagctggtgcgatcatagagctgcaccgaggtggtattggagtcgtcggtgggatcgatcaggcgatacgcactggcctgttcagcttctccctccttcatcagccgctgatagcgtgcttccatggcgatgacggcggcacgggcatgggcgggcatatcaatttccgggatcacctggatgtgacgggcctgcgcatacttcacaatctcgatgtagtcggcacgactgaaatagccgctgccgttgttatcgctgaacggaccggaaccaagctgcggcagcaggcagcgctgtttcgctcaggtcatggcagcgtttagcccccacgtcagtcaattccggtaagccgggaatctcaatccgccagccctcatcgtcactaaggtgaaagtggaagcggttcatcttccaggccgccatctgatcaagcagccgcatcactgcctgtttactgtgaaagttacgggcaacgtcaagaaacgcgccgcgataggcaaagcgtggcgcatcatgggcttccagcgtggcaatacgcggcgtgccttctgtagggatcagcgagagaatcgacatcagaccgtagaacgcaccggcagcatcgtagcccaccacaatggcacggcgaggggtgatatccagatcgtatgcgcccggtttagcctgtttgccgctgaagtgacccggtttgatctgtgtcctgatggcaaatccatcaggatcttctttcaggccgagcagggccagacgctgctttaccgcctcaccggtttcacgggtcagcccggtcagagacagactgacgccacggctgagatcggcatcctgcggacgaagtttcacctcaagcggcgtgggtgtgatttgaccgcgcagcgcggaagcgggcagggtggcaacatcgctgtttttatcaaaccggctggcgggttgcatcaggatattccggtcatcggcactgcgtcgccagttatcccccaacggcaacacaaactggctgggatcttcatgatcggtgctggcaataattttgggggtggcctgcccggacgtcacataccagcgcggcatcacatccgtggcaaacagctgccagtattcgttaacgatcggaatctgcaccgattcgcccgcgccaatgccggtgaacttctcagtcggctccagccgggtcaggtcgccgaccagatgggtcattttaaactgttcgttatcgacccgcagcgtctggtggacgttgctcatgtagattgcccagtgtttatcggtcagggctgggccgttattggtcagggtaatggtggcgcgattgcaggcggcatagtcggcacccagcgcggcgcagtcggtgccatgaagggcggcctgattatcgttcacctgataagtgacgccaaactggctgatctgattcaccacctgctgcgctgacgagctggcgtgacctgtggctgcaacgcccagcagagtgagcgcgataaggcttaacttaaacatattgattcatccttgctgctgaagagatatccgggaatctgcagggcctcagaacagtgtaaacggcacgataaccataaatttgatgtccttctcgtcctgaaaaatgttgccgtaaccgccgctgtaactgggcagattgctgtgattgtcgtagcgggtgtaatgcagtttaaacagggtatctttggcgcggccctgctggatttgatagctcagatcaaggttccaggcggactctttcagccgctggctctggtcaacggtgggcagcgtggcgggtctggcatcccagccccagacgtacgatgcgcccactttccatcccgccagttgccacggcgttaagtcgagcatcgccccggcaaagatcgctttttcgccattggcgttccagtcggaaacgggcatcccaccagatatccagtcgtccattggagctggcgtagcctggcgtcatgcgctgcaggaagaagccctgattcccctctgctttgacccagctgccttccaggcgcagatcaaccgggccgacggtatagccgaccgtgattgcctgtaaccaggccaggccgtcatagacatcacggggattagcggcaccgcccgctactttgtcgtgcgccccataaaactgatagctggtgtaaagtgcattgccaccgggcgtggctgaccacgaggctttggcaaaatattgatccatataatccgccgcctggccaaatgcgccctcaagcaccagattatttttgaactcatatttcataccgaacgaatgcaggtagctgacaggggttttgccatcagcctgacgaaaatcatataagtcacgataccagggcgctttatatttgtcgctccacatccaggagagcgataatgtaccagcctgctggaaatcatacagcgcaccgacttcgacgccgcgataggttccaggtaaaaaactccagtgtggcgcaataattgtctggccggttggctgaatataaccggcacgcaaccagtaatcgttatattttaatttcagtgcggctttataaacagaagcaccgccgctgtcgccattccacttttcatcccagcgggtacgcgccttactgaagccaatttcattgggtgcggcggggccgctgttggaaagctcagcagcaccgaaaatggcgaggtccagaccaatccactctccggcatagcctgactgatagtcgagattactgttgagcgaggcatgatgtaaattagcccgatactgcccctgatattcactggcgggatcggtgtctctgcgatctcgctgacgctgccagtaaaaaacattacctttaagcgatgagtcctcaataaatccgctggcgtaagccggtgatgaacttattgcagttaacgctattaatacggtggctatttcaactaacgctaacgcgtaattaatttttcgcatgatcattcctccctgaatgcaatccggataattaagcagaatataattattgtggcggtaatctatttttcgcgacgcgaattatcaattagcagcgtggtgatttgtgaactattgcgcagaacccgatgagataaaataaagcaggtgcaatatgggaggggagattaattttctgatgaaaatgttagctattggcaggactgttgcaatgggaagctggtggtgcgaaacgggcctcccggttgtatgacaatcagcctgctcagataagcaggctaatccataaggcgattaaaactgcttcaccgcccatcccttttgcttactggttttgccaatcccaggattgaagctgttggtgggatcgagctggcgatagaacgccgccagctgcggtttggcctgatagagatgtccgacgttatgttcagcgggatattccgcgccccgcgcctgaagaatctccagcatctgcgctttgagcgcatgcacatcgacgccttttctgacgatgtaatcctgatgaaacacatgacagaagaagtgaccatagtagagacgatggctcagcgaggcgcggatctcatcgggcagggtttcgaaccagtccgcatcattacgacgcagggcgatatccagcgccagaatgtcctcgacctcatcagaatgcaccgcgtggtagcgcaccgccgcacccgccgctgcgaagcgatgcagaaaggcgtgcgcaccttctttgccttcacactcgaagaattcgccaccgccttcgcggaagtagtcgcgcagatagttacgcgcttccgccacgccgtcgccagacatctttagcatcagatggtgttcatatttgtcgcgatactgcttcatgcgtttcggcagatgcgccggaaacagtttactcaggcgctgcaacaggcgatcgctgaagtgcggtttaacgaaggagagtttgctcagccaggcatcaacccgccccttcagcgtgaaaaacagcggcatcttgtcggtgcccagcttgtcgatcatcaggaaggtatctttgccgtagacttccgcaatgtcatagatgtcgcggtgcatatattcgcccgccaccggcagatgggtgaaatgcgccagcatgtgacggcgaatatcgctgagaacaccgggctcgttggtgccgatgtaaaacacctgctgctgcggttcgctggcaaaggtatcgagtcgtaccgcgaagaccgccagcttcccggcacaaccggaggcttcaaacaggcgacgcgcatcggcgttataacgagcgggcgtatccgcatctacttcacgaacccggtcggcatattcatgatcggaggcgtgacggccatcgtgctgcacatctttgggctgccagcggtcatcatccagccgccccagaatctcttccggtgacgtcccaagatcgataccgagatggttcaccagcttcagttttccctgcgcatcaatctgggcaaacagcgccatttcactgtaggccggtccgcgtttgatcagcgatccgccggagttattacagatgccgcccagcaccgaggcaccaatacaggaggagccaatcaccgagtggggttcacgccccagcggcttcagcgctttttccagctgatagagtgtgctgccggggaacgccagcacctgctggccttcgtcgatcagctgaagcttgtccagtcgcagggtgctgacaatcaccagcggacgatcgtaatcgtccccatgcggcgttgagccttcggtcaggccggtattcgccgcctgcatcaggataatgacatcggcattcaccagcgtttgcagtacccgccagagctccagcagcgtaccgggaaacgccaccgccagcgcctcgccttcgccggagcgaaagcctttgcgatagcgcgcggtctgttcaggttcagtcagcagatgggtggggccgaccaggcggcgcaggtcagaaagcagggcagaggtttgtaacatgagcaattcccttgtcttatcagtgcgtcctaactgtagcacgtcaactcacctcaacgcagtgtgacagcggcagctacctgctattctcatcttgtggcacactgccgcctgtttattcgatattgcgcagttacttaagagaacccaacctgatgaaatggatttactctgttagtctcgctgtctccctcgcgatgcaaccggcattggctgagacagtgccaggtaaccacccgatgaccgaacaggcgcgggatgccttcgtcaaccaactgcttaaaaaaatgacgctggacgagaagatcggccagctgcgtttaatcagcgtcggacctgataatccgaaagaagtgattcgcgacatgattcagaagagtcaggttggcgcgatttttaataccgtaacccgtcaggatatccgcgcgatgcaggatcaggcgatgcagctcagccgcctgaagatcccgctgttttttgcctacgacgttattcatggtcagcgcaccattttcccgattcctttggccctagcgtcgagctgggatctggatgcggtgaaagaggtggggcgcgtctctgcctatgaagcggccgacgatggcctgaacatgacctgggcgccgatggttgatgtcagccgtgaaccgcgatggggccgtggctctgaaggtttcggtgaggatacgtatctcaccagcgaaatgggtcgcagcatggtgcagtcgatgcagggcaaaagtgctgccgatcgctacagcgtgatgaccagcgtgaagcatttcgcgctctacggcgcagttgaaggcggacgcgattacaacaccgtggatatgagcccgcagcgcatgttccaggactatctgccgccctataaagcctcactggatgccggcagcggcggcgtgatggtggcgctgaactcgatcaatggcgtacccgccacggcggacagctggttgctgaaagatctgctgcgcgataagtggaagttcaaaggcatcaccatcagcgaccacggcgcaatcaaagagctgatcaaacatggcgtcgccagcgatccgcaggaagcggtacgcatcgccctgaagtcgggtgtcgatatgagcatgagcgacgaatattacagcaagtatctgcccgctctggtgaagagcggcgacgtcaccatggcggagattgacgatgcggcgcgccatgtgctcaacgtcaaatatgacatgggcctgtttaacgatccctacagccatttaggtccgaaagagagcgatccgcaggacaccaatgcggaaagccgtctgcaccgggctgaagcgcgcgacgtcgcgcgtaagagcatcgtgttgctgaaaaaccgcctggaaacgctgccgctgaaaaaatcgggcaccattgccctgattggtccgctggcagacagtcagcgcgacattatgggcagctggtccgccgctggcgtggcgaagcaatctgtttcgctgctgcagggcatgcgcaatgccaccgaaggcaaggctacgctgctctatgagaagggcgccaacgtgaccgacaacaaaggggttcaggacttcctgaacctctatgagcaggcggtttccgtggatacgcgttcaccgcagcagttgattgatgacgcggtcgccagagcgaaacaggccgatgtggtagttgccgccgtgggcgaagcgcagggtatggcgcacgaagcctccagccgcagcgacctggtgatcccgccgagccagcagaagctgttagcagcactgaaagccaccggtaagccgctggtgattgtgctaatgaacggacgcccgctgtcagtggtgaatgaagatcggatggccgatgcgatgctggaaacctggttcagcggcaccgaaggcggcaacgccatcgccgatgtgctgttcggcgactacaacccgtcgggcaaactgccagtttccttcccgcgttcagtgggtcagattccgatctattacaaccatctgccaaccggtcgtccttacaactttgctaagccgaacaaatacacgtcgcactactacgacgcggctaacggtccactctatccgtttggttacggcctgagctacaccactttcaccgtgtcgccggtaaaaatgtcctcaccgaccatgccgcgtaacggcagcattgaagccagcgtaacggtgaccaacagcggtaaacgcgatggcgcgacggtggtgcagatgtacctcaacgatccggtcgcttccatcagccgtccggtgcaggagctgcgtggctttaagcgcatcatgctgaaagcgggcgagtcgcaaaccgtgacctttaaaatcgacgtggatgcgctgaagttctggaaccagcagatgcagcatgttgcagagcccggcaaattcaacgtgatgattggactcgattccgttcgtaccgaggatgggcagttcaactatttataaccgtcagcctttcccctgacgtcaggggaaggtgatgcggcgcgtcgttagcgtcctgctacggcgcgccgcgtcatatccactatcagagccatcatgattaatctgcgtgaccgcattcagcagcaggtatttcgccttaacggcctgtcgatgaatgaatttgacctctctcaaccgcctggcgatcccggcctgtttggcccggacagcgtgatctggcgcgtccacggtgacttcacctccatgatgtgcggcgggatcagcgcgctgctgttgcagatgctgcatccggcggcactggcgggcgtctgggatcactccaatttccgcgaagatatgatgggccgcctgcggcgcaccagtcagtttatcgccgtgaccacctacggtaattcgcaggatgcacagacgctgattgaccgggtgaaacgcattcacctgaaagtcagcggcgttgacagcgaaggcaaaccctatgccgccagcgatccgcatctgctgacctgggtgcatgtggcggagaccagccgttttctggccgcccatctgcgctacaaaaatccccagctcactcgcgccgatcaggatcagtactatcaggaagcggcacagatagccgaagcgctgggggcggagaaggtaccgaaaagcgttgtcgacgtcgcggattacctgcaacagatgcgttcagagctgcgctttgatcatcgcactgccgaagtgacgcgattgctgatgaatgcccctgcacccagctggcaggcaaaaccggtgatgaaaatcatgctgaagtcagggtttcgggctgatgccagcctgggcgcaggcaatgtccggtacggagatcggccgctttcagcaggcgatcattgaccggaagattaatgcgatagcggtggggttaaggtggtcgattcagcgcggtgcctggtatcgggcgatggtgcggatgggcagggtggggtgaggggtttgcttgtaaaaatgtgagtggcaagtggtcataaagagattaggcagcactagtgattgatgctgctaattggatagacgcttttgttcacccaataaatttatttgggttattcaaaataggctgatcggtgcagatatcaacgtccgctttgtgccagaagcagacctttttagaccgtcatttaatctttcagagagctcgattcttcagagagccattgtcttagaatgcttaatataaatatctgaacggtagactaaatcgtatcctcgctcagccttaagtttgtactgttgaaacgcaacaacaagccttcctgcagccacatcatccgcaatccgagatcaaaagcgcttatgacaacgccaaacgagcattgtcgggtggactggtgaaaaccaagagcagacgaacaaagaggcccgaagagcttcaggtggaggtagatcgcctcaaggccgagtcagaggcctacaagcgaaaggaagaacaatagctacgccgctggcagcaaatcgcctttcatgtgcggcagaaaggcatacagatggctagtgtggataaaacctctgctgaaagggctgagctgccctataataatgaaaccgcgcatatactccggccttttgataaagaaattccaccttcagggagaacataaaatgagtctagaaataaaaaaacaaagtaacccgttttctactggtggtggtggagttaatttcgaaacaagagttcaagcagctttcgcactatccttaatgactaaatcttgtgttccttgtttaagtaattacatgagggctaaagagttaaaactccagaacaaatatgatggtgtaaatactgatgattttgtattgactgccacagataactcaaataatgaaagtaagatctttgctcagattaagcatgaaataactattagtggctcatcaaactcagtatttgcagaagttataaatagtgcttgggcggactttaaaagtgtgggctttaagtcagaaagagattcaatcgcgttaataacaggtattttacccaaagctgacataaataatactttgccgttacttgaatgggctaagttttcatcaagctcagaggattttataaagaaatctcaaacccaaggatttaccagtaaagcaaagctcgacaggttaggaatatttagagatcaacttactcatgcgaataacggggtggctatctcagaagaagaattgtggtctttcttaaaatcgtttcagatattaccttttgacttagacgcagaacattcaatcgtagcaaacttactttgttcattgattcagtgttactcagacgtattaccttctctagtcttagctagacttgtttcctgcgttcaaagtttcaatcagaatgcgggagttttaactcaaaataatatcccagaagacattaaaggattatttaataaatcaaactacttatatttcgagaatgacttaataaagctttatgagcgcagtcagcatatttttgaaggtatttctacaactataaatggactccatgttgataggacagaacaactagcagcactatctaactgctatagagatagtgagtttgtatttgttaccggtgcaagaggggctggaaagtcaggcgttgttaaagattttatcacaacaaaaaatatagatattccagtcttctacttaagagctgaagatttagataaaagtcacttaaatgaagttttcacttccatgggaattacatcttctttgggagaaattgaaagtcatttctcattgcttcacgaaaaagtactcgtaatagagtccctagaaaaagttttagaattaaattatccaaatacttttgttgagttattgcaatacatcagaaaacagtctggttggactatcattgcaactggccgggactatgcttatcaacaattgtcatttaatttcctacaaccttgctctataaattttagcagcatgaatattcaagggcttgaagatagtcaagtcgagcaagtttgccagcatattccagagctaaaagctctagtgtctaatagcttattagtagaactactaagaataccattttttattgagattgctgtaagagctataaaaaatggcgctcaatttgggattggagatactgaagaagactttagggatatagtgtggcgaaactgtcgttgcaaaagaagctgatagaaagtcagggatgccagatagaagaagagtaacctttattaaaatagcaacagagagagctaaaaagatgctttttggtgtcagagcaagcggttttgacccagaagtaatcgcaaagttggaagaagaccatttgatctacagagatcaaaaatcatcttgtgtaagtcctatgcatgatgttttggaagattgggctttagatgagttcatcgatagagagcattttgataattctcataatgttgcaagctttttgttaaatataggaaatgaacctgcgataagtagggcattcaggttatggctgtataggaagctaaaatttgatgatacaactaatgaattcgtagaagttttattatcttcgaacgagatagagagttattggaaagacgaggcaatttctgcaatcatgcagcatgactctcctggaatatttcttaattcactcaagcgccagcttcttaaggatgattgtgctcttttgacacggttttgttttattctcagaataacgtgtcaaagaccaatatctctatacaacggactactgataaaggatcaaaaatcgggattgctaaaatcccttttcctaaaaccatatggagaaggttgggaagcactattccattttatttatgaggaaaaagataatttgagtagctctgtgcgtactcaagttattgagttgatagatgaatggactggtctcattaatatacatgatgagttgccaaaagcgtctgaaaaggttggttttttaagtttatggcttcttgaaaaggttaaagattcatatcgaggtgaggggcaaaggaaaaaaatattaaatgctttattaaaagtctcaacggctattaaagatgattttgatgaattgatgaaacaggacgttttcacctcaaagataaagcctagtcgattaagttatgttgatgaactgagtagtttggcacttataggcttcaatgttcctatgttgtgtaagttttatcctgacttcgtagttaaactttcaatgcatgagtggctgttggaaaaagccgaagagaacggttatggctacgggtcatatcgagtagacgtagaggaatcatttgggctagatacagaaacgagatttttttcctgcgagcggtgccaaaggccctttcaaatatcttctccaattcaagccaaggctaggcttagatttcattattagattgtgcaatttgacagcacaaaaatattcagaatcggatttttccaaacctcaagacaatgaagaagacactatttacgccttcgaaacagtagctaaacaagtcgatataaccctgaatgatggcacagtagttaaacagtatgcatctccccacctctggaagggatatagaggacagtctacgttgccctacttattacagagtgctcttatggcgttggagaactggttagttgagtacgttgaaaattgtggtaagaataatgaaatagattggatttttgattatgttcttcgctctagtaattcagtaatgcctacatctgttttatcttctgtggccacaggcttccccaataaagtaggtaaagccgcctttcctttacttaaaactgctgacttataccatttagatttgattcgaatgacacaagaaatgggtggaaatgagatgcatttctttggtcttaatagggatgcattgtcggatatatacctgaaagagagaagagaagcagcacttcgaccatggagaaatgagtcattagaaaccttattaacaaggcttcagttcgtaaatgagctaagggatgatattttaaaaattgttgatgaactgaaaaatgaagctactgcaagtaatgaaaaaagtcttcgatatatggtgcacagagtcgatacaaggacttgggaattagttgaagacaaagaaaatgacagagtattgtttcaaagctcatcagagcttccgggagatttgaagctggatcaacaagagtttaatgaaaagcatgcaatggataacctcgtaactagtttaaacttatggggtagaaaattattcgatgagcaattactagaagaaaaatacttctcttcatatcaggacgcgttaatagctactaagggattgctcagcgccctccaaaaaggtgaagttcacaactttgctgatatggcggttggcacaatcacaactgttgcagcgatttgtgttcgtgattttcttttagaattgagctatgaagataaaaattggtgcttagaaatcatcctagaatcaatattcatgcacgcagacaatatgaatgggacagctgcacatgataagactgattattatggctctggagcatgcgcatttgtcttacctaagttatttgatttagatctagattcagaacaaatagaatatttgaagttttctttagctacagcattaacgcatgagaaacctgaacgttagtgcttgtgctgctaagggagtaagagagtttctttggtctagagacgctgaattagcatcccgttgtgtaggtggaatagttgagtatgccagattacgaagggaagatagtgaggtacgtaggttttatcatttacaaggtgctgaattgcaagccgcactcgaaaaatggaatgatattttaacaatttttcgtaacgacttgattgagggaaagtttaagatttctgttaacgatatatctttggaaagccactgttcgtggttcattcatttaccaatgctaatggttccttactgtactaaggatgagatacaaattcagttggtcaacaggataatgagttttgtatttgatacagagtatcaaaaccatcgttcgagtgatgataaaaaaataaatcatgaaattaaaaagcagattcaagattgcctctctgaacatgttttttcttcaagaaacaataagttcatgccctttaaagatctattggtattagggtgtacaaaagctcccggcttcatttattcgttaacactctcctatcatgtcgcagtagaaaaagaaggtgattatgatgctatatgggcactttggtgcctgttagcaccagaagcacacacgatagctttgaatgatgttaatgatcgttatatcggtttacagaatgacctaaatcagctactgcgtggaatgatgtatgcggatagcccttggcaaggacatgagaatgaagagaaagatatgaagcgaggtgctaaatatttactcggttttgctaggcaatctgcacataatagccatgtgtttgaagccttgtcttcattgatttataacttctacaacgtattcttcgaagaaggcattctgattttagctaagcattatagtgccaatcgacatattatcgggaagcaagtgtatacagcattctatatagaaatggtggttggaagatttttgcagatagaaaatcgcggaactctcagtagaagaatgtacgatatatgcctgcttctcttaacaggaattgtagaaactggctctgctagagcttattacttacgtgaagaattgattcgttctcgaaagatttcagcctagagggtaactgtgacaatttttttacaaaatgatgatggctcagctgagtataaagaagcgattcttcgatcttttattagtctatgactagatcaaaagttcaggatgctcagactgataggttcattgagctttgattgatttgcactggaaaagaggctagtccatcacatcaatgtccaatggtatctcaataactaccaaaatgtatcgagattaaggtgatgagcgaaattctgaccttcggtttgatggtaggccaaccggcattgcgtaacctgtgcctcgtggttcacctagaaacactgttagcaatgtccgcttctcgctcatagcggaccttggcctgtcttcagtccactatgtgccagaagcagaagttgaaatgccagagactatataaaaactgatggttcgttttgcaggaatacttacataatcaactactattcaatgggaaaaggggtgggtattttacagaatggtagggataccctgatgacattctttagcatcaattgtagctcagcgctggagaatttatggatctctaacttttgtgccagaacaataaacttatcctgactgtcttgcgtgcgagtgtgcaattctgtttccattgcgactttattgctttcgctctgactacaccaggtttcataccaaaaagagagaaatatatgcatcgctatctcagcatcattttgcataatacttggatctaatcctttaataaacgttattgtgttatgtaatcggatgagtgtcctaggatttccgatgcgaaagacctgtgcgcattcaacaaatatttcatattcatcatgattttcttctaaatattcatctggctcggcctctttttcctcattctcctcaaaaaactttaattcatctgggcaggttggtatgatatcttgaacaataacgtcagtgatatcattgaactcaatttcttgctctttttcatctgtcgtactgactgttactgatttttttacacccttatacaaacttttatggatgaagttatttatattatttcttgatggggtatcaatagcaacagatgcttggaatatcttgccaagatatattctgcttttaatagttgcttgctcgtctgtcagtgtattatcttgctccttccatttcaaagtgaatgcttttgcaattgaattatagtcaattgcgaggatgatattaacattctgaattgtagaaattagttgtagcgcactaactgtatcaataattttaccatcggaacagcgatcaagatcatcaatagttataatatatttggtcttaacccccgactctgaaaatttcgatgaaagacaacgggtaaatgatgtggcatcgctgataaacaaataagaaaggtgatgccgaatcgtctgtcccaatccaatatgatcactgaatttttttcgtttgataatatcccgaattttctttgcaatggggttttcgaaataggtcttaattaaagaaatagcagaagtgagagcggttccaaatagtgcagcggtcattaaggtagatgccgtagtgagtttaaaattatttacagtcaaataagccacaatgaacgatatagggagtagaatgagaagttctatttttaaattatcttttgctgatagtaatcttgactttaaattcaataacagttgctgaaatatgttttttgattcgtataactcatcaatgatttgattagcaatggacgctagaaccgcattgctatgttcttcatgccaagcattataattgatgaattttagctctcttttttcaagggtgtttttttgtagcattgtcagaaacagagctttttcctattccccagttgccgagtaatgctaaattaagatttcctctctcacccttggtcagtatgttttcaatcaagtcaacaatctcaatgcgcccaagcatatctattgttgcggggcgatcatcaagtggattgataagcttacgcctgtttttgctatctgaaatacgtagattcagattttcggtacgaaatgcacccatttcttcaaaaaaatactttctattatatgaaaaatcccatattttaggtgcagcggcctttgggagcgtgcagttaatgagtgctttactgaatgcatcttcggatggaagttttcgcaacaatacaacatcactgatttttatattgctgagaaaatgatacatattaatagttactgcaatatctaacttgtctgaacgttggaatttattaattttatcagtaaccatcgcatcatgtgagctaattgttactgctacttcttcttttgcactagaatttagtgccattgttaagctaactgcgatagagtgactcttgcatattattacaacttttgaagtgcttttgttataaatgtttttaataatccagcgagcaatgttatcttgtatctcttgttcattaagcaggtttgggtcaaccccgttaatagatattacttcagttttgtttaataccccgtctgtaaatgcatcaggcatagaatataaaaaagtgatttcacctgcaatctgttgggcctctggataggcaacactactgataatacatttttttactgcattaaaagatggagtggttagttcttttagcaatttctttttggtagaataaccatctaatataataaccaaattcaaatttagtgatagattttgaatactattgagattggatgcgattatgataataacacggtcagctgaatctattttaacaggctttttagagtctaataccctggattcaatgttaagcatgcctaattgatattgtaattgagctgcaataaccctgaggtcaacaacaattaaaacttggccattttgcatatacaactgagcgatttcgctggcgacgagtgattttcctgagcctggagccatgagcagtaaggctttaccagactgtgacagactttgattcgctagctggattgctttctgttggaacccgcgcattttattatactcttccttaacattttaattggctgcgatagaagaaaaatggcgtatagtgatgtgaaaatggattcaaaaaaattccatcgctaacgccttcaggtctgtgcgcagcataaatactcatatagttgtgctatgataacgtgttcaagttacattgcaaattcaacattttcaaaaatttattttttataaggaccggccatgtccgaaaatttgcaatacacttcatcgctacataaaaaatccctttgtaccaacaatgatataccacccaaaaagacatcttagccatgtattccatcattgtatgataatctgagtagattttgtccttcatcaatatcatgtaagctaaatgttcttttcccattattggcctcaaagctgattaaatagaattttttttaaaaaaccctcgacttcatcagtgtcatcaagatcaagttttagatactcttcactagccagcattgtatacttgaaaccaacgtacctctggtccgataacttccacttcccatacaccaaacttttcgtgattcttttagagaaaacagtgatattgcaaagaagtatgctgaggtaaaacaatcggcggcatctctcaactgaaacgatgctcatcgctatagaccgctcaaagcgaacttgatagagtatcatttacaactggcactgactgcttaggcacgatcttccgcattatttgttggttgagcactcatgcagcttcctcctctcgctcagagcagacttgatggtcatccagcctttctgctttgtgcccgccacataagttcggtccgacaaatataatcagcacaatgcctttgaaaaacagagtgcctcttctctgccaatgtatgggccataattatcaatacgaaaatatccatttttctcgtaaaaattgacgccttggcggttgctatgtgtggtttccagcttaaactcacgatatcctatttgctttgcagaagtttccagaaaagtaagtaatgcactacccacgcctggcatgcttcgtttctgaaaaaattcttttgagctcggcgagattttgcgttaacggccgggttgcctcgcatcttatcgcatcgcttttgctggccaccacgctgcttaccggttgcgatgctggcgcgaagagtattgattggtataaagcgcatgacgcggagcgcaaagctaaatatgaggaatgcacgaaagcctctgatcaacgcggtaccgaagactgccgtaatgccattgatgccactgtccacggcggctcttttacaaagagtcccaataaaagttggtaaattcagacgagccgccgcctggcggtttttatgcccttctgcgggcacaggtaacgtcccttcagtcagccactcaaaggcagacgccgggcacaattgacattgttctcccaaaaagcaatagttaatttttagaatcaagtggatctactatattcgcacataaggaatggaattctcatgtcatatagctgctatttacttctcaatcggcgtgaaatgaccagcctgagctgccctggtattgttacatttcctgctttttctggtcaaaaagaaggccgcaataatccagaaaaaacaaacgtacccgatataggcccaatagttcgtggccgttactttattgtagaacgaccttcaggcggaagattgggaccgtttagagaacgcttgttgaaagacatatacggtacggatcgctcaacatggtttggactatttcgtgacgatggaaaaattgatgactacacgtttgtacaaggcatcaggcggggtaatttccgtctgcaccctattgggccattagggctgagtgaaggctgcataacacttcaacatcctcttcagttcaattacatgcgcgacatgttccttaaatctggcccaacgcttaacatcccgggcagccagctcaaagcctatggaaacggtaaaggtatactaacgatgcgcttaatttttactattttgctgtttgttttttgtgcgattgctatttcaaaagctattgctgtcatagtgccggtaacattcttttatgccatcgcaggttttctcaatattaatggcgatgaggcaaccctcgactttgtactctcagccaatatccttatttctatcattatgtctgttgcgcttttatgggtgctgaaaggttttttcaaaaagcattaaacaggacgatatgagtaccattgattagaaaagtcagtctgctaaccatagtgaacgctacaatcaacaccgtatccggttgactttatggggcagtgcatcgcgctccttcgctgcatccacccgttactgtaagagcattatcagaccgtgatggtatgattatgctgccagatgggcctctactcccgccaattgcgcctgctgtactcttcactgcactccaaccccccacactttgagactattacccttgtctcagatagccgcagccaggatcctgctctattctcggggaaaatggattcctccaggctttgtcgaggcactatgacgtacaaatccctgattgctgaagtccacaatcagcagcgcaccctgaccgccattgtcgaacaggatgagcgcactgcctatttttacatctggccaaccgacctgttccgcagccagtatgcggtacgcggctgctggctacgaaacctgctgccggcaccggcgcaggaagatcgcgaggcgatggagcagggcatagcgccgctgctcagcgccgagtattgccgtaatctggaatcggaacccgcgctggatccagctggtctgcaggtgctatgggagccgagcgatgatggcgcggcgctgtggtactacggccagctgctggcggtgatccccggctggagtctctatcaggagaagcaggtgagcttctccgcgggctgcatcaaaaagaaccggctgacggcaccgctgggatcggcatcaaccaatgactactacgcccgtgcagagcatcagcgtcagtttctggcgcgaatggcacgacggcagcgagtgggataaggtgcagaacgatctgatggcctgctatcaggcgcgctttggcgagtcagtgaagtattacgctatcgatcagggcagctggccgccgatggcaatctcccagcactggcatcagggcgtctggtatttcctgaccatcggcatgagcatccggccgatgccgcaggtcgattatctgtttgatgaactggcaccgcagtatcgccgcattgaactcggcatggcggttgacggtgaagtcatgaccgaaggcaacgcggtgcagatggccagcgcgctggcggagttcgtgcatctgccgtgggcgcggctgacctggctgggcgagggccatacgctggcgtcggaagtggcccccgtcggctttgaaagcttcctgctggccaatgagctggcaaccgatcaggcgcagttctcgctgccaaaacgcgacggcgatcgcccgactctgctctggactacgccgattacggaagcggaacggcagttcgcgcaggcggatgaacatggcggtcagaagttacgggaattgttaacggcggatggcaataatcacatcttccgcccgcgccagcaggtcgtcagttcagaagagtaggccagcaataatgcgcctgttcgcccattccccggctcccgccggggatgtgatagtttctcactgaaattaaatttttacataaatcaaacatttctcaaatatgtgatcctgctcatctcaagttcccgcttgccgcgccgttaaacccgatcaggcaatcgcgccgcaccaggttcaggggaacgaagatgtttaaaacaacacaatcccgcttcaccgcaacaatgatcgcgttctttgttgcgcttttactcgttacagtctgggttattaatcagtttgtcgcgccacagctggtcgatagcgaaagccgtctggttcgctatcaggtggattcgctggcttccggtatcgttgaacagatgaaccgcgttcaggcccagcagcgcgccattaccgaagccgcatctgtcatggagagcgccactatcgacacccttttaccgacgctggttaaccagtatcaggacagcaatgtgtttggtggcgggatctggccactgccaaaccgtcgtgatccggccaaagagaaggacagcagcttctttgcccgtaatgccagcaatgaactgcaggtgaacacttactggaactccgacgcggctgacaaatactgggagcaaccctggtacaaagatggcatggccgctccgaaaggccagtgtgcctgggcaaaagcctatcaggatgccgccagtccgcagccgcgcaccaactgcgctatggccatctacaagaacggcacggcctggggtgtcgccaccatcgacgtgacgctggggttctttaaccagctggcgaagcagatgggtgaaaccattcagggcaacgtcctgatcgttgaagccgacggtaaaatcgtgggcaatggggcactggtgaatgccgcaccgaagctggagaacctggctgacgtgcagatgccgatggcagcaccgctgaaaacgctgcttaacggtgttggcaatcagccgctggaaaccacctatgacagcagtgaaggcgagcagacgctgttcgtgcaggccattcctggcagcccgtggtatctcgccagcagcctgccaaccagcctgctgaaagcgcagtcgcacaacatgctgacccgtctgggtctggtgcagatccccctggcggtgatcctgctgctggtgtcgctgggctttgtccgcgccatgatgaaacgcctcaacgtgctgaacagcaacatcgaagcgctgtcgaccggtggtgcggatctgactcagcgtctgccagccagcaacagcccggagttcaacgccgtcgcgcagagctttaaccagttcatcagctatctgcaggggctgctccagcaggtgggcgacagcgcgctggcgatcaccgccgcgtcgcgggaaattgccagcggcaacgctaatctctcttcccgtaccgaagatcaggccagctcgattgtagaaacggccgcgtcgatggagcagctgaccggcaccgtgcgtcagaacgccgacaacgcaacccacgctaaccagctggcgggtgatgcctcgcaggtggccgcacgtggcaccgaagtggtccgtcaggtggtgaccaccatgggcgagattcatcactcatcccgtaaagtggtcgatatcatcagcgtgatcgacagcatcgcattccagaccaatatcctggcgctgaacgccgcagtagaagccgcacgggccggtgaacagggtcgcggttttgcggtggtggcatcggaagtgcgtaacctggcacagcgttcagccaactcggcgcgtgagattaaaaagttaatcgaagagtcggtggcgaacatcgataccggcagcgcgctggtcgagcaggcgggtcagaccatggatgagctgatgaagggcgtgagcagcgtgacaacgctgatgagtgaaatcatgtcagccagccgcgaacagagcctgggcatcgaacaggttaacgttgcgattactcagctggatggcactacgcagcagaacgccgtgctggtggagcaggtttctgctgccgcgcaggcgatggaatcgcagagcacccagcttgagcgggtggttcagagcttccgactataatccctctccaggccagccttgctggcctgattttctctctgcttcatccgcttatctccgcctgacccgggtaaaaaatcctcgatgatccgcccaaaccgataattctgtgccagaatagttgggaataatctcaaggaaacgccatgtctgctattgaagttatcctcgttgaccacctcgatcgtcccaccggcaagatggaaaagctggaagtgcatgaaaaaggattactgcaccgcgcggtgacggtctacgtcttcaattcccggcaggagctgttgctacaacggcgtgccagcgataaatatcattgtggtggcttgtggagtaatacctgctgtggtcatccttatccccatgaatcaacccgcgacgccgccgagcgccgcttgcgtgaagagatggggatggtggtgacgctgacgccggtgtttgagctgagctacaacctgaaactgagcaatggcctgactgaacatgagtatggtcacgtcttctttgccgtctgcgacagcctgccgcagctgaatccgcaggaagcggatgcctgggattatcgccctatggcgctgattgagcagcagatgcagcagcagccacagcagttcacaccgtggtttttgcacaccttcccgcgcatcccggactatctggagcagtttcctttcccgcaagttaccgcataaaaataccgcactaaggtgcggtttcaatgctggccggagaagtcgggccggggtaaacaatgcgccagggttataagcccgtttgctccctgagcctgcgcgctatccacgccctgaccattgattatcgctgcagctcgaaatcctccgcatccacatcataacccgacggttcccagcggatcgccagcagcgccagcaggcccgccagtggtgccaggaagatcacccagaacacgccggtgcccagcgccgcgaccagcaccggaaacagaaacagcgaaacggtagagctgccgcgcatcagcgtctggttaaagccgacacccacgccacgcagcgacgtcgggtagctcagcgacgcaaaagtcatggtatgggagccaggcccgaatccctgtccaaacaggaacagcgccagcataccgatcgccagcgcggcttcctggccgccttccggacgaccaatcagcgccagcccgagcagcgccacgcactgacaggcatatcccgccaccgacatcttccacgccccgaggcgcggcaccagccgcaccgccagtatcccgccgacaaaggcgaacagcagattcaacgccagcgacaccagaatggtggtaagcattgactgggcaaagaagctggagatgatcaccggcaagccaaacgccaccgcgttataagcaaaagatgaggcaatggaagtgatggtcgccagcagggtacggcggcgataaacgccctgtaacagcgcgccatagttacgccagctcgccttgcgcaccggcgtggcaggcgtcagcgcggcgtcaggcgccacctgagcattaatactccacgcactgcgtaaaatcgccgcggcacctttcaggtcgccctgattcgccgcccaaaccggggattcgctcatgtaacggctacggatggcgatgatgataatcgccggaaacggcaccaaaaccaaggattagacgccagagccagtcggtgtggctttcgggtaacacggcatagagcagcagcaccagcagataagagatgctgatcgccgcataccaggttgggcaccacatcgccacgctagccgctttatttcccttgccacgcagtctggaaaactccgccagaaacgccatcgccaccggcagatcgattccgactcccaggcccatcacaaaacgcgcgccggccagcacatactcattgggggcaaacgcacaggcgatagccgccaccacgaaaaagaacatatcagccataaacacccgataacggccaattttatccgtgagatagccgccgatcagcgcgccgataatggccccgaaggtgattgccgaggcgaccatgccggtgccggtcggggtgagattaaattcgcgcgtgatgtctttgatgccaaaggccagcgcacccaggtcgtaggcgtcaaggaagacgccccccagcgcaatcgctaccacaatgcgggcattattacgggcgctgtcgccactgttcactaatcgggagacgtcagctgcgctgcggatccactgtgtttcgccaccgggcgaactccctgttgttgccacgtgggcggaagaggtcaggtcggacatgatgttgtgcgtcttttattataaaaacagatttccgagaatagccgtttagacgcccagacgtaaattcatttcggttatatgagatgaatttataatctcaaatcgttatcaatttgcgataaagtcagctacatcgccgctgcgccaggctacgcttttaaggcagataatttccgctgcacgccttgccagcctcccgcagagtggcaggagggcagcctgaacgcgcaggcgcacaacgccttgtgaatcatcacgcaagaacaaaacgtaaaaacaacacactgcgataaggaaaaagccatggtcagaattcggggttggatgggcgtcagcgctttgctgctcagcatggggatagcacaggcggcagacccggtgcgggtcggctcgaaaattgataccgaaggttcactgctgggcaatgtgattcttcaggtgctggaaaagcacggggtaaaaaccgtcaataaaattcagctcggcaccacgcaggtggtgcgcggtgccatcacggcgggcgaacttgatatctatccggaatataccggcaacggtgcatttttcttcaatgatgagaaagacagcgcctggaaaaatgccaccgaaggctacgagaaagtgaagaagctggatgcggagaaaaaccatctggtctggctgacgcccgctccggctaataacacctggaccatcgctgtgcgaaaagatctggctgaaaaaaatcagctcaactctctggcggacctcagcgcctggctgaaaaaaggcggcactttcaaactggcggcctcagcagaatttattgaacgcagcgatgccttacccgcctttgaaaaagcctatggctttgacctcaagcaggaccagctgctgtcgctggctggcggcgataccgctgtcaccatcagcgcagcggcacagcagacttccggcgtaaacgcggcgatggcgtacggcaccgacggtccggtagcggcattaggtctgcagacgctcagcgatcctaaaggggttcagccgatttatgcgccgacgccggtgatccgtgaatcggtactcaaagcctatccagagattgcagagtggctgaagccggtgttcagcgcacttgacgagaagacgctgcaacagctcaacgccagaatcgcggtcgacggtcaggatgccagcagcgtagcgaccgaatggctgcagcagaaaaagctgctgtaaccgatgcagatatcgcgggaagcgatacgccgtccggttgagcagccggtggcactgctgctgctgacgctgctgactctggcgctggtggcattgccgtttctgaacttcgccccgaaccgcctggtggcgggtgaaccgctgatgggctggcagattagccgcttcgggctgttgctgctgccgctgttgacgctgtggctgctgctgtggcggcatccgacccgcatcacgctgatgctggcgctgctggcggcagaactgatgctggcggcgatcatctggctcagcggtcatcaggccactttactcagccagcagggcagccgtctggcgcgcaccagctttgccagcggattgtggtgcagcggcgcgctgatcctgctgctgatcaccgatcaggtgcggcaactgacccgccatcggctggcacagctgctgctcaatctgcaggtctggctgttgccgctgctgctgctgttcagtggccagctcagcgatctctccctgctgaaagagtatgccaaccgccacgcggtgtttgatgccgcgctgagccgtcatctcaccctgctggcgggcacggtggtgcctgcgctgatgattgcgctgccgctgggcgtcacgttgttccggcggcctggctggcagggcggggtgttcggtgtgctgaatgtgattcagactgtgccctcggtggcgctgtttggtctgctgattgcgccgctggccggactggctcagcagtttccgtggctcggcgactggggcatcagcggcattgggatggctccggcgctgatcgcgctggtgctttacgccctgttgccgctggtgcgcagcgtggtggtggggctgcaacaggtgccgcacgaggtgcgtgagagtgcacgtggcgtcggcatgagtggctggcagcagtttattgcggtggatgtgccgctggcgctgccggtctggctggcgggcctgcgggtagtggtggtgcagacgctgggcatggcggtggttgcggcgctgattggcgcgggcggctttggcgcgattattttccagggactgctaagcagtgcgcttgatttggtgttgctgggggtgatcccggtgattgcgctggcggtggtcatcgatgcgctgttccgcctgctgatctcactgctggagagaaaagatgattgagtttgacggcgtttcccgcgcgtttaacggtaaagcggcggtgaaagatctgtcgttacaggtggcgaaaggggaattttgcgtgctgcttggcacctccggttcgggcaaatcgaccaccctgaagatgatcaaccggctggtggagtttgacagtggtgaaatccgctttgccggagagttgattcgccagctcgatgcccgcacgctgcggcggcgcatgggctacgccatccagtcgattggcctgtttccgcactggacggtgcggaagaatatcgccacggtgccagtgctgctgggctggccccgggcacaggtcaatgaacgtatcacggcgctgctggcgctgcttaatctcgatgcgcagctgctggaccgctatccgcatcagctctcgggtgggcagcagcagcgcatcggcgtggcgcgggcgctggcggcggatccggaagtgttactgatggatgagccgtttggtgcactcgacccggtgacgcgcggggtgctgcaacaggagatgttgcgcattcatcaactgtcgggccgcaccatcgtgctggtgacgcatgacatcgacgaagcgctgacgctggcggaccgcattgtgctgatggataacggcgagattgttcagcagggcaggccggtggagctgctcacccagccgaaaaatgattttgtgcgcgacttctttggccgcagcgaaatgggagtacggctgctgtcgctggagcaggtcggtaatgccgtgcggcgcggcgagtggctgccgggcgaaccgatcgctgcggcactgacgctgcgctatgccctgtcgcagtttatcgcccggcgtaccgataaactgccggtcattgacgatcagcagcggccgctgggcgtgctccactttggcgatctgctgcaactgcgcgaggatttaacatgcgcaggctaagggatccgctgctgtggctggtgctgtttctacggcgcgctgctgaccctgatgccttgcagtgggccgctgtttcaccgctggtttcccgaactggcgcggccactctatcagcaggagagcttctggcagctgacgctggcgcatctgtttctggtgatcaccgccagcctgctggcgattgtgattggcatcggcagtggtgtgctggtgacacggcgggcggggcgggccttccggccgctgatggaaaccattgtggcggcagggcagacgattccgccggtggcggtgctggcaattgcggtgccggtgatgggatttggcgcctggcccgcagtcgtggcgctgctgctctatggattgctgccgattttacaggggacgctggcgggtattgatagcgtaccggccagcagtcgggagatcgccatcggggtcggcatgagtagctggcaacggctgtggcagattgagctggcgctggctgcgccggtcatcatcgccgggatacgcacctcggtgatcatcaacatcggcaccgctgccatcgcctcgacggtcggcgcgaaaagtctgggatcgccggtgattatcggcttaagcggctttaatacagcctatgtcattcagggggcattactggtggcgctgctggcgatagtcagcgatcgcctgtttgaacgcctgcagcgctggcttagcgtgagtgaacgatgagagagtatcccaccagcatcagaccgccggtgccacctgccgccataataaaaaacagcgtggcgaagaaagcttttttacagttcatgggtaaaacctgagctcgttaacagtgaggcggggataatagcgcgcgcaaggcagcaggcaaagtgcccggcgtgcgtttttgttatcaggcgggatcgtgcaaccgcacggcatagccctgttcctgccagtgtgacagctgttcctgctggcggcgggtcagttttttaccggtaaagacaaacatattcatgccgggaaagagttcaggacgcggtaaatccagcggttctgccagcacatcaatccgccagccatgctgcgacagacgccagccttccagccagattcgggtacgatcgtcgataccccagccaataatcagcgcatctttacccgattttttgcggctgccggtcaggcagaaacgcgacataatcgatcagcaaaccatccagcagactgcacatggtgcgggcggtgttctggtccagactcagcttctggcgcaccggcataaaaacatggtcgatcagcgcatcaatcggatgttcgcgaccaatcgcggcaattttattacgaagtttagcgggtctgacatgacgcaggacgctgatcagctcatcctggagtgtggtccagccgtcatgggcatctacatcgccaccttccagcagtgccttaactttaccgaccggcacgccgctttcaatccagcgcataatttcttcgatgcgatgaacatcttcttcgtcaaactgacgatgtccgccttcggtacgttgcggcttcagtaagccataacgacgctgccaggcgcgcagggtgactgggtttatgccacagcgctcggcgacgtcaccgatactgtataaggtcataaattcctctttcgattggtctgagtgcaattaccataacgaagccgactaagttgtacaatacatttctcgatgtacaacttgactgatacgccgtttctccgttatatctcatataagagaattattcccaaatatgagaaatcaccatgtcagagctgaatacggagcaacgactggcggtgaggctggcagaattacgcctgcaacgcggctggtcgctggatgaacttgctgtcgcaacgggcatcagtcgtgcgtcattatcgcgcattgagcgaagcgagaccagccctactgctgcgctgcttaaccgtctgtgtgttgcctacggattaacgatgtcgcgcctgctcagtgaagtggaggaggagtccagtttgctgatcagagatgaccagcagcccgtgtggcaggatgaatccagcggatttattcgccggaatgtttcacctcctgcgcttcatttccgatgcgaactggttgagggcaaattacggcccggtgcacgtatagattacgatgcgccacccattcaggggctggagcagcatatctggctacgcgaaggcggcctcaccgtcacgatggggccgcagcagtgggcgctgaagcccggtgattgcttacgttttcatctggtcgggaaatcggcttttgaggcgcacctgactgacggcgcgcgctatttactggtggtggcgaaaccatgatcgattacagaatacttcgcgccgacgaagcgcaaccgcaattggatgaactcacagcggtgctgcagggctgtgtggcagacggcgccagcgtcggctttattgatgctgaagacgaagaggtgatgacgcgattctggcagcagcggatcgccggtctggcagagggcgacagcgaaactattcgttgcgcggcagcacggtcgcatcgtgggcacggtcattctcagtggcagcgcgatgcctaatggccgccaccgggcggagatcagcaaattgctggtgcatccgcaggcgcgccgtcagggcatcgcgcgtgagctgatgcagcgcgctgagcagcaggcccgtgcgcagggcaaaacgctgctggtgctggatacgcgcagcggcgatgtcgccagcgatctctatcgctcgctgggctggcaggtggcggggtcgatcccgttttatgccgaatccaccgcgggcgtgctggatgccaccacctatatgtacaaagtgctggcgtagccagccgctagctcatgcggctggcctttcttcgtgccggaccggcccgggttgacgggctgcccgcacgaccctgaaacgggcaactgctgaaatttacgacgtcgcacgaaaaattcggcgcgaaagctgacgccaacaggatactgtgtaaaaatacaggccatattttcggtgtggtaacgcaaatcatggccctgacagccgcagtaaaaagccagatagcgcagtggtataaagcgcttcaggagcaggtgcctgacttcatcccacgtgcgccgcagcgccagatgatcgccgaagtggcgaaatgcctggcgggcgacgattcgcgccatctggcggttgaagcgccaaccggcgtgggcaaaaccctctcttatctgatcccgggcatcgccgccagccgcgcccaggagaagcggctggtgatcagcaccgccaacgtggcgctgcaggatcaaatcttcaccaaagatctgccgctgctgaaaaaaatcattcccgatctcacctttaccgccgcctttggtcgcgggcgctatgtctgtccgcgtaatctggcggcgatggcggctgatgacgatgagcagggcgatctgctgctttatctggacgatgacgccgtcagcagcactaaagaggagcagacgcagtgtggccggttgcagaaatcgctggatcgctatcagtgggacggcctgcgcgatcacagcgacgagaacgtcagcgacagcctgtggcagcggctctccaccgacaaagcgagctgccttggcgcacactgtcgctggtatcgtgaatgcccgttctttgtggcgcggcgcgaaatcgagcaggtggatgtagtggtggcgaaccatgcgctggtcatggcagcaatggagaatgagtcggtgctgccaccggcaaaaaacctgatgctggtgctggatgaagggcatcacttgccggaagtggcccgcgatgcgctggagatgagcgccgacatcacgccgggctggagcagcctgcagctcgacctctttatcaagctggtggagagcatcatgacgcagatgcggccaaaatcgccgccgccgctggctaacccggagcggctgaaagcgcactgcgatgagctgcgcgaactgctgacgattaccgctcaggcgctgaatccgctgctgccaccgcataaccagccgggcgaattccgctttgtgctgggcgcgttgccgcaggagctgctggatctctgcgcccggctctttaagctcagcgatgcgctgcgcggcctgagtgaaggtttgattaatgcgctgagcgagcagaccggcaaggtggatgtggtgcgactgcatcgcaatctgctgcagctcaatcgccagtttggctggttcgaatcggtcagcaaactgtggcggctggcggcgatggaaaaagcctctggcgcgccggtatcgaagtggatcacccgtgagctgcgcgaaggtcaggcgcacctgctgtttcactgcgctggcatccgcgtcagcgaccagctggagaagatgctgtggcgtaaaattccgcacgtggtcgtgacctccgccaccctgcgatcgcttaacagtttcaaccgcctgcaggagatgtcgggactcagcgagaaggcgggcgaccgatttgtggcgctggactccccgtttaaccacgtggagcagggcaagctggtgatcccgcagatgcgctatgagccgctgatgacgcatgaagcggagcatatcgcggagatggccggtttcttccggcagcagatggcggagaaaaagcacaaaggcgtgctggtgctgtttgccagcaaccgggcgatgcagcagtttgtcgcctgtctgcccgacctgcgcctctcaatgctggttcagggcgatcagccgcgcagccgcctggtcgatctgcatcgtcagcgcgtcgccaaaggggaaaccagcatcctgattggcctgcagtcgtttgccgaagggctggatcttaaaggcgatctgctgagtcaggtgcatatccataaaatcgcttttcccccggtagacagtccggtaattttgaccgaaggcgagtggctgaaaagccttaaacgctatccgtttgaggtgcagagcttacccagcgcctcttttaccctgattcaacaggtcggacgcctgattcgcagccatcaatgttatggcgaaatcgtcatttacgaccgccgtctgctgagcaaatcctacggcagccggctattagcggcgctgccgatcttcccgattgagcagccggaaacaccagagccggcagcgataccggccaccgtggtgccaaaaaatacggtgcgtaaacgacgtcccacgcggcgctgagccgcgcacttaaccggaagcgagtgatggaactgaataaaatcattaaagagattggtcgcggtaaaaatcatgcccgcgatatcgactttgatactgccgtggcgctctatggcgcgatgctggcgggcgaggtgccggacctggagctgggcggcattctgattgcgctgcgtattaaaggcgaaggcgaagcggaaatgcgcggcttttatcaggcgatgcaggcgcagatgatgcaactgcaggcgccggaaaaccgcccgatgccgattgtgatccccagctacaacggtgcgcgtcggcagggcaatctcacgccgttgctggcgctgctgctggtgaaactcggcttcccggtgctggtgcatggcgtcagcgacgacgcgacgcgcatcaccagtgaagcggtgtttgccgcgctgggtattacccccgtcaccaccgcagaggcggcgcaggcaaaactcgatcagggcgaactcgcctttatcaccatcgatcatctctgcccgccaatggcgaaacagctgtcgctgcgctggcgaatgggcgtgcgtaacagcgcgcatacgctggcaaaactggcgaccccgtttgccgaacgtgcggcgctgcgtctgtcgagcgtgtcgcatccggagtatgtgccgcgtgtggcgaaattcttcagtgacatcgatgcgcctgcgatactgctcaatggcaccgaaggggaggtctatgccaatccacagcgctgcccggcgatcagcatgattcagggcgcaggcgcggaagcggaagtgtgggttgagcgtcagcccgaagtggccgttgaactgccggccgataagacggcagaggtaaccgcgcgctggattgagcaggtgctgaatcagcagcggccggtgcccgcatcactgcgactgcagctcgcctgctgcctgcgcgccagcggccagtgcgactcgctggcggcggcagagcagcagatcctcgccgccggttactgactcaggctgctggcagcgcctgttcaaccaggttctgccagaaagtaatgccaattggcagcagcgcgtcgttgaagtcatagcgggcgttgtgcagcggggcggaaggcgtgtcgccatccgcgcccagccagaagtaggcacccggacaggcctccatcatgcaggcaaaatcttcagacgccattgacggattgacctgccactgaacctgttcggcccccagcgtcgccagcgccacctcgcgcacctgctcagccggggccgcatggttggcggtcaccggatagcccggtaaccactcaatctcaccgctgacgccaaacggacgtggcagggtagcgacaaactcatcaatcagcccgcgtactttttcgcgcacgctggtctgcaggcagcgcaccgtgccgcgcagcacaatctgttccgggatcacattgatcgcttcgccaccgtggatctgcgtcacgctaaccaccgccgaggcgagcggcgagagccgacgtgacggaatcgtctgcagcgccagaatcagctcagccgctaccaccattggatcggcaccgctttccggcatcgccgcgtggcagcttttgccgtgcagggtaatctcaaacgaatccagcgacgccatcatggcgccagggttaaccgccagtgaccccagcggcaggcccggccagttgtgcatcgcatagatcgcatccatcgggaagcgctggaacagtccctcttccaccattttgcgcgcaccgcccaggttctcttcggcaggctgaaaaatgaaatgtaccgtgccgctgaactggcgtgtggcggccagctgtcgggcggcggccagcagaatggcgctgtgaccgtcgtgcccgcaggcgtgcatcacgccgggagtggcggagcgccattcagtgtcgcctttttccgtaatcggcagcgcatccatatccgcacgcagcccgataaccgggccgggaccgttttccagcgtgccgattacgccggtgcccgccagaccgcgaaacacctgcaatcccgcccgctctaactcatcagcgataaactggctggtttgctgttcctggtaacctaattcggggtggcgatgaaactcacggcgccagcgcagggcatcttcaagcagggcaggggaaagggtcatgcagagtcgcgctccatacagaatgagaagatttcactttagaggtcgggtggcgctgcgtctatcgccggcaggacgaaatctggctataggctaaatcaaaatggaataagtaataaggaagtgatgtccgggcagggcttcagaagggaaaaatgcgaagaaaacggggcaagccactgcccgccccgttcagcgtattacttctgcatcggcagattcaggtcatgctctgccgcgcaactttgtgccagctcataacccgcgtcggcatgacgcatcacgccggtggccgggtcattccacaacacccgacccagacgcgcatccgcctctttgctgccgtcacagacaatcaccataccggcgtgctgcgagaagcccataccgacaccgccgccgtgatgcaggctgacccaggtcgcaccgcctgcggtgttcagcagcgcgttgagcagcggccagtctgagatcgcatccgagccatccttcatcgcttcggtttcacggttaggtgaggcaaccgagccgcagtcgagatggtcgcggccaatcaccaccggcgctttcagctcgccgttgcgcaccatttcattgaacgccagaccggcaagatgccgtttcgcccagtcccagccagcagatacgtgctggcagtccctggaaggcgatgcgctcctgcgccatatcgagccagcgatgcagcgttttgtggtgcggaaacagttctttgagtttcgcgtcggtcttgtagatatcttccggatcgccggacagcgccacccagcggaacgggccttttccttcgcagaacagcggacggatgtaggccggtacaaagccagggaagtcgaaggcgttgctgacaccctcatccagcgcgacctgacggatattgttgccgtaatccacggtcgggatgcccatatgacagaagtcgagcatcgcctgcacgtggaccgccattgaggcacgcgccgctttctccactgccttcggctgtgagacgcgttcctgctgccagcgcgccagatcccagccagccggcagatagccattaatcggatcgtgtgccgaggtctgatcggtgacgatgtccggttttggcccgcccgcccgggcgcgtttcaccagctccggcaggatctcggcggcattgcccagcagcccgaccgaaatcgcttttttcgccgcggtcgcttcgctgattaacgccagcgcttcatccagcgtggtggctttgtaatctacatagcgggtacgcaggcggaaatcgatgcgcgactcctgacactcaatcgccagcacacaggccccggccagaacgcccgccagcggttgcgcgccgcccatgccgcccagtccggcggtgaggatccagcgtccgctgaggtcgttgttgtagtgctgacgtcccgcttccacgaaggtttcataggtgccctgcacgatgccctgcgcgccgatatagatccaggaaccggcggtcatctggccgtacatcatcagacccgctttatccagctcatgaaagtgatcccaggttgcccagtgcggcaccagattggagtttgccagcagtacgcggggtgcatccgcatgggtgcggaagatgccgaccggcttgccactctggatcagcagtgtttcatccggctgcagtgcccgcagcgaacgcaggatctgctcgaagcactcccagttacgcgccgccttaccgatgccgccataaaccaccagatcttccggccgctcggcaacatcgggatcgaggttgttctgaatcatgcggtaagcggcttcaatcagccagttggcgcagtgcagcgtggtaccgtgaggcgcgcgaatttcacgtgccacagcctgagaaagagtttcgctcatgaaagattccttaattcaagaagttgggcgcatgctcggcagcagcgcggtcaatgcctgaggccagtcagtgcgacttgcccactgacgcattgcctcgatatcgggagccagcaggcgatcctcctcaaggaaggcgacctgctcgcgaatggtgtcgatggcctgctcaatcagcgcagagcttttcagcggccggttgaattcaatgccctgtgcggcggccatcgcctcaatgccgactaccgcggcgctgttaaagcacatgctgccgagacggcgggcggcgtaggttgccatcgagacgtgatcttcctgatttgcggaggtcggcagactgtcgacgctgcccggatgggccagcgatttattctcagaggccagcgcggcggcggtcacctgggcgatcataaagccggagtttacgccgccgtcgcgcaccaggaagggcggcaggcccgacaagccgctgtccagcagcagcgccagccgccgctcggagatggctccgacttcggcaatcgccagcgccaggatgtccgcggcaaaggccaccggttcggcgtggaagttgccgccggagatcacatcgccgctgtcactgaacaccagcgggttgtcagaggccgcgttcgcttcgatttccagaatccgcgcggcgtggctgaagttgtccaggcaggcacccatcacctgtggcacgcagcggatggagtagggatcctgaaacgcggccgcaatgcgtatgcgacagcactatttcactgccctcaatcagggtgctgacggcagcggcgaccgcaatctgaccatgctgaccgcgcgcctgatggatacgggcgtcgaacggttttagcgagcctttaatcgcctccagcgacagcgcaccggccatcagaccagcggcaaacaggttttcaccctcaaacaggccgcgcagcgccagcgcagttgagacctgggtgccgttaagcagcgccagtccctctttcgggccgagtacaaatggcgacagacctacgcttgccaggccttcggttgccgggatcaactcacccctgagccggacctgaccttcgcccagcagcatcagggacatgtgcgccagcggtgccagatcgccggaggcaccgaccgagcctttttccgggatgcagggcatgacacccgcattaaacagcgccagcagcgcctcaaccagttcgattcgcacgccagagtgaccgcgtgccaggctgatgattttggtggcgaccaccaggcgggtaacattgtcgggcagcagatcgcccagcccgacgctgtgtgacagcaccagattacgctgcagatccgccagccggctggccgggatttgcgtctgcgccagcttgccgaagccggtattaatgccatacaccacgttgccggaggcgacaatcgcatccacggtctgctgcgccgccgcaatcgcctgacgcgcgggctcatcaagcgtcagtgtgacgttgccctgatagatagcgcgtaatgtggcgaggtccacctcgcctggcaccaggcgcaaaacctgaaacgaacctgacatagtctactcctgtctatacaagtgtgctggtgtggctaaactgctctccttgccctgatccagcggaataatacgagtgaaacataagcgttaattcttgtctatgcttgtctatacaatcaaagagagcaagcaagtgccgtgccaggccgatcacaaaaatcgattgcccgtccgctgcgggttgactatttagcgctactcagaggctgcaccatcaggatgcgcaggctgcaccattggggcaccgcgcagcgtactggatgtatatacattcacacggtgagacagtaaacttaggggactttcagcataaggaacagcaaatggttgagcatacggcactggcacaactggcggcggcaatgagcgatgagcctgccccgatttatcagcgggtgaagcaggccatcgtcagccagatccgtgaagggttgtggaaagcgaatcagcgtgtgccatcagaaagtgaactggtgaatgaactgggcgtcagccgcatgaccattaaccgggcgctgcgtgaactcaccagcgaaggctttctggtgcggatgcagggcgtcggaaccttcgtggcggagatgaaaggctacaccgccatgctggaggtgcataacatcgccgatgagatcgctcagcgcggccatcagcacagctgcaaaatcctcgccatcggtcaggacaaagccgatcctgagcaggcggcggtgctgggactgaccaccgggcagacgctctatcattcgctgattgtgcattacgaaaatgatctgccggtgcaactggaggaccgtctggtcaatccgctggtcgcgcccgattacctgacgcaggattatcagcagatgacgccttacacctatctgatgcgcgtcgcgccgctgacggcgggcgagcacattgttgaagcggtgttgcccgatgcgcgtcagcgtaaacatctgtcggtggatgagcacgaaaccctgcctgctgattcgccgtcagacctggagcgacactaaaatcgtgacctatgcgcggctgctctatcccggctcacgttacaaactactgggccgcttcaggggacacggttaagacgggtaaacagcagccgggcatcggtatcgcacgggctgagtgctgtttcttcatcgacccaccacgcgccctgctgcgcggtcagccgttccccgtcagccgtctgccatgcgccagccagcacccaggcgacgccatgcagagtgctgactggcgtggtcaccacctccaccgctgcctgccattccccgcgccgcgtcataatattaaaatcttcgctgacgctgccctgcagctttgccgttaaggcgagttcgccggcaaacgcccagggctgctgaggcgtcagtaagtgctgcccgcccggcgcggtcagcaacaccggatcgccatgcagcagggtaatcacccgatcaatgtcaggaaaggcagagaagggaccatcctgcgccagcgtcgcaatgctggcgcgccagccgaagcgctccgcgccgggtggaaagctgatgatttcgcgggtttcgccgccgccgttgcgccagcggctgaccgccagctccgcgtacgtgaaccgggcgatcatcgcagcgcctccatcgcctgagcaaagcgggcggcacacgccgtctggtgcggatgcaccccatcttcaaccacggctttacccgccacataaacgtcccgaatctgatcgcgctgcccggcaaagagccagcggttgaggacggcgtgcgacccgacgctgccgagccacgcctcatcccgcagcaccagccagtcggcacgttgtcccaccgccagcgtgccctgctgaatgccacacgcctgcgcaccgcccgcagctgcctgttgccacagcagatcgcctaccgacggctggccgggcagggtaatccggttgcgacgctggtcgcgcagtcgctgagcatactccagccagcgcagctcctcctgggcgctcagcgagacgtgactgtcagagccgatgccccagcgtccgccctgcgcgatgtactccactgccggaaagatgccgtcaccgaggttggcttcggtggtcgggcagagacccgccactgcgccactgcgggcgagacgcgccagctcactctcatccagatgggtggcgtggatcaggcaccagcgcgcatccacctcaaagcggttcagcagccaggccaccggacgctcgccgctccacgccagcgagtcattcacctctttctgctgttcagccacatggatatgtaccggcagtgtcagatcactggccgccagcacgtcctgcatctggctttcactcaccgcccgcagtgaatggaaacagaggccacggttcagcagtggcctttgctgctgccacgcatcaagccgcgcctgctgttgcagatagcggtcggtctgctggataaaacgcttctgacccgccgacgctggctggctgccgaagccgctgtagctgtagagcaccggcagcagcgtctggccgataccggcgatctccgccgcttcaatcagctgttgcagcatcgcatcatcactgtagggcgcaccctgtgtgtcgtggtgcaggtagtgaaactctgccacctgggtgtagccgcctttcagcatctcgatgtagagcagggcggcaatatcgcccacctgttgcggcgtcaggcgctgcaccatgcggtacatcagatcccgccacgtccagaaactgtcctgaggatcgcccgccacttcagccagacccgccatggcacgctggaaggcgtgcgagtgcaggttggcgattgccgggatcacctcgccgttgagccggatagcctgatcagcgtggctatccggggtaatggagtcgataaaaccggcctgattgaccgtgatacgcacctgctgctgccagccctccgccagcagggcacgcgaggcaaaaaaagtcgccatggttgatcctcatcggatgtggttgtatatacatatacatactttgaggcacagtgtaaacggcggaggcatgaggcagcgatggcagaagagatgcgcgtagagacggtgtggaccggggctgacctggtcaccatgcgtgacggaaagtaccatcttatcccgcagggcgcgctggcggtgcgggcgggcaggctggtgtgggtcgggccgcaggcggagatgcccgcgttcgtcgccgatcagcatcatcatctgccgggcggcatcgtgaccccggggctggtggattgtcatacccatctggtgtttggcggcgaccgcagccaggagtttgaacagcgcctgaatggcgtcagctatgcagagattgccgcgcagggcggtggcatcctctcaaccgtgcgcgctacccgcgccgccactgaacaggaactggtggcatcggctcgctggcggcttaaccgcctgctggccgagggcgtcaccaccgtggagatcaagtccggctatggtctggatgaagagagcgaactgcggatgctgcgggcgattcgcgggctgggagagagcgtagccgctgacgtgcgcgccacctgtctggcggcacatgcttttccgccggagtttaagcacgacccggatggctgggtcgatatcatctgcgaacggctgctgccgcaggtgcaggcactgggactggcggatgcggtggatgcgtttctgcgagcatctcgccttttcaccgcagcaggtggcgcgggtgtttgatcgggcggtggcgcttggcatgccggtgaaactgcatgctgagcagctctcggcgtcaggtggcgcagcactggcggcgcgctatggggcgctctctgccgaccaccttgaatatgccaccgaggaggatgccagagcgatggcacagcatggcaccgtggcggtgctgctgcctggtgcattttatctgctgcgggagacgcagcgtccgccggtagatctcttccggcgctatggcgtgccgatggcgctggccagcgatgccaatcccggcacctcgcctgcgctgtcgctgcgtctgatgcttaatatgggctgtaccctgtttggcatgacgccggaagaggcgctggcgggcgtcacgctgtggggggcaaaagcgctggggctggctgacagtcacggctcgctggaggcgggaaaagtggcgaacttcgttcactggccgctggcccgtccggcagaactggtttactggctgggtggtgaactgccctgtaccgttatctatcgtggagaaccgcaatgaaccctttccattttacccagggcagtctgccgctgctggtcagcattccccacgccggtaccgagctgacgcccgacgtggaagccggactgagtgaggccgcgcgcggcttacccgacaccgactggcatattcccctgctgtatgattttgtgcgtgatctcggagccagcgtgttaatcggccgctactcccgctttgtggtcgatctcaatcgcccgcccgataaccagccgctctacaccagcgccaccaccggcctgttcccggaaaccctgttcgacggtacaccgacctttgcaccaggcaaaacacccgacgacacggcgcgtcagggctacatcgatcagatctggcagccctatcatcagcagattcaacaggagctggcgcggctcaaagcgcagcatggctatgcgctgctgtttgacgcccactctatcgccagtgaaattccccgcctgtttgacggccgtctgcccgatatcaacatcggcaccaacgacggcgcaagctgcacgcctgcaatgagtgcggcgctggaggccgtgtgcgcggcgcagaacgactacagctgggtgattaacgggcgctttaaaggcggttacatcacccgcgcctacggtcagccgcagcagcagattgagtcggtccagctggagctggcgcagctcaactatatggatgaaaccccgccttacgcctggcagcaggcgcgtgccgcccggttgcagaacgtgctgaaggcattgatccacgccatgctggcgcaggctaaatcgcaataaaactcaccagagcgatgcgccactccggtgcatcgctgccctgattaagtgcagcggcgggcaggtcgcctgcccgctcccaggctaccgccgcttttttccacctctgcagagctggcataacctttgcttggttgtatgtacaagtgcagcagcaccgccatctgcgtaataaattctgtctggctcacaaaacgataaagccggcaatgaactgcgctgcgttaacttgtatatacatgacatatcatcctgtgaaatttatgttaaatctcgtcagggcgatcaccaggccgctactttcaggagaaccgtatgacgcaccctctgactcttcgtcgtttatgtctcactacgctggtttccagcctgctgctctgtggcgtcagcgcccaggccaaagagtggaagtcgatcaccattgccaccgaaggcagttatgaaccctggaacctcaccctgccaggcggcaagctgggcggttttgaaccggagctgatggccgatctctgccagcgtatggcaatacagtgcaagctggtggtgcagaaaactgggatggaatgatcgccggtctgaatgccggaaaatatgacgtgatcatggatgcaattgtgatcacccccgagcgcaagaaagtgatcaatttcaccgtgccctacgcctctacgcccgccaccttcatcacggtgaaagggtcgttgctgcctgccgacagtaagatcatcaaactcaccgacgatgagaaaaccgtggagccagccatcgcacccctgaaagcggcgctgaagggcaaaaccatcggaatcgcctctggcaccgtctacacgccgtttatcgacaagtacttcaaagaggtggcggatgtccgggaatacaccagctcagccgatgcgatcctcgatttgcaggcggggcgtattgacgcggtgtttgacgatgtgacctttgcgcagtcgatgctggcgcgaccggataaccgtaacctcagctttagcggtccgcagctgggtggcccaatctggggtgagggcgaggcgatgggcgtgcgcatggcagacaacgatctgaaagcccggctggatcaggcgatcaaagccgcgctggccgatggcacagtgaaaaagctgagcgagaagtggttcaaaactgacgtcacaccctgagtgaggtaactgatgataagcctgctgagttttggcccggagggctggggacggttgattctgagtgccacgctgacgacgttgctgctctcatttgccgcgctgctggtcggtgcggtagtgggatcgggcgttgccgctgcaaagttatccccgcaccgcgcggtgcgctgggcaggggaaggctactcggtgatctttcgtggcatccctgagctgctggtgatctacctgttctacttcggcggatcgggattgatcacgcagatcggacaactgtttggcgcggacgggtttatcgaagcgccaccgtttctgatcggggcgctggccatcgggcttatttccggctcttaccaggcggaagtctatcgtgccgcacggctggccctggcgaaaggggagatcgaagccgctgtcgctattggtatgccgcgctggcgcatccggcaacgcatcctgctgccgcaggtagcgcgctatgcgctgcccggcctgtcaaacgtctggcagatgagcctgaaagactcggcgctggtgtcagtgaccggcattgtcgagctgatgcgggccagccagattgcggccggctccacccgtgattacttctccttttatctggtgggcggtgcctgttatctgctgctgacgctgctgtcgaaaccgcgcctttctgcgggctgaatcccgtcttggtcgcgcctggcaaagccgcaccgctgcacagcattaaggagatttatgatcgatttcgcgttcctcactgacaccttcctgaaactcagcgccgcgttgccggttacgctgggcctgtttatcagcgccttcctgtgcggcggcgtgctggcggtgggtattctggcgctacgcatgagccgctggcgtctgctgagtgcttttgcccgtggctacattctggtgtttcgcggctcgccgctgatgatccagctgtttctgatctactacggtctggggcagtttggtgtgatccggcacagtctcttctggccgtttctgcgtgagccctttacctgtgcggtgctggcactgtcgctctgcaccgccgcctacaccgcggagatcctgcgcggtgcgctgctggctgtgccgcccggtcaggtggaggcggggatggcgtgcggcatgtcgcgcgggctgctgctgcggcgcattatcgcgccggtgatgctgcgttatgcgctgcccgcttactccaccgaggcgattctgctggtgaagtcgaccgcgctggccagtctggtcacggtctgggatgtcaccggggtggcgcagcagattatccagcgtacttaccgcaccatggaggtgtttctctgtgcggcggcaatctacctgatcctcaacttcatcattgtgcaactctatgccctgctggagcggcgtctgacgccggttcataaaccggaaaaaaagccgttaccggccgctaagccgattcctggaggaaaataaacatgtctgaactgccacccgtcacgctgtcggccagcgatatccataaatcctttggcgccatggaggtgctgaaaggcatctcgctgcaggcgcaccagggcgatgttatctcaatactcggtgccagcggctcgggcaaaagtacgctgctgcgctgcattaatctgcttgagacgcctgacgcgggcgtggtcagcgtgggcggtgaaaccattgagatgaagcgccatgcccggggacaccagctggcggctaacccgcgtcagattgagcggctgcgctcccggctcggtatggtgtttcagagctttaacctctggtcgcacctgacggtgctgcagaatgtcattgaagggccgcactacgtcctcaggcgcgataaaaaagcctgtattgcccaggcggaacagctgctggatcgggtcggtctgctgaatcgcaaagatttctatcccgcccagctttcaggcggtcagcagcagcgggtggcgatcgcccgggcgctggcaatggacccggaggtgatgctgtttgatgagccaacttcggcactcgatccggaactggtaggcgaggtgctgaaggtcatgcgcagcctggcggaagagggccgcactatgctggtggtgacccatgagatgggttttgcccgcaacgtctctaaccgggtggtgtttatgcatcagggcactattgattgtcagggcacgccagaggcgatgttcggcgaggcgggatcggcgcgctttaagcagtttatctccagtcatcatcaggtggagccggtggtatgagcgacgtaatacgtcagacgctggtctggggcgatggcccgctgaaatggcaggcgctggtgcaggtcgcccggcacggcgccaccctgatgctgagcgacagtgcctggcagcgcattgcgcagagccgtgaaatcgtcggtaatatcgtggcggcggggcaggtggcttacggcatcaataccgggctgggggcgttgtgcaacattaccctgtctgaagatgagctgagccagctgtcgcgcaataccctgctgagtcatgcctgtggtgtcgggccggtgctggcaaaacccgaggtccgcgccattctgtgcgctgcgattgcgaactacagtcacggcaaatcgggtgtttcagtggcgctggtgcaacatctcctggcgttgctaaacctgcagattacgccacaggtaccgtcgcagggatcggtgggatatctgacccacatggcgcatatcggcctggcgctgattggcatcggcgaggtggagtggaagggcgaaatcgttccggcgcagcaggcgctggcccaggcgggattagccccttaccggcctggtgccaaagaggggctgagcctggtcaacggcacaccctgcatgaccggcttagcctgtctggcactggacgatgccgaacggctgctggactgggcagacgtcaccggtgcgatgagctttgaggcgctgcgcggtcagctggtggcgtttgaccctgaggtgctggcgctgaaggccagcccggggattcagcgcagtggcgaacgcctgcgccagttgctgagtgacagcccgctgctgaaagccagcgttggcatccggactcaggatgcactcagtctgcgctcgatgccgcaggtgcacggcgcctgtcacgatcagtttagtcacgctgtccgtcaggtggagaccgaactcaacgcctgtaccgacaatccgctggtgctggggacgccgcaggcctggcgcgtggtgtcacagtccaatccgcatggcgagtcggtggcaatggcctgcgacctgctggcgattgcgatggcggagctgggcagcatcgccgagcgacggcttgatcggctggtgaatccgctggtcagcggcctgccgccgtttctggtggccgagccgggcgtcaattccggcatgatgattgcgcagtacgtggcggcatcactctgcgcggagaaccgtcagctggcgcagcctgcggtgcttgataactatgtcacttcaggattacaggaggatcatctgagcctcggcaccggctcggcgctgaagctgctgaaactggtcagcaatgttgatcacattatcgcgattgagtatctgctggcggcgcaggcgctggagtttcacggtgaatcacagctggcagcaggcacgcggcgcgcctggcagcatttgcggcaggttgttgagcgctggcagcaggatcgctggctggcacccgacatcgcctgcgcggtagctcagattaaagcgcaccgggccgatgcgcttgtggggtgaggattacctgcggcgcgcgtccggacggactaaatcaaaacgttgcgcttcgctgatgccgtaataggcgctggggccgcccgcgcgcagaatcggctcggctttagcggtctgataaatgccctcttccagcagcgattcatcgatgtgaatcgccaccgcttcccccagcaccagccagctgtcgatcagattgccgctggcatcctgcagctgaatcagttgcgtcagtcggcactcgaagttgaccgggctctctgccaccagactggcgctgacctgtgaagccgccagcggcgttaaaccggcaaaggcgaactcatcctgatcggcaggcagcgaggcggaactttcgttcatcgcttccgccagaggacgcgtcgccaggttccagacaaactctttggtctcagcaatatttctcacgctgtctttccagccactactggcgaaaccgataatcggcggatgatagttgaagcagttaaagaagctgtaaggtgccagattgcgctggccgctgctgctcactgagctaatccagccgatcgggcgcggcccgataatggcgttcagcggatcgtgcggcagaccgtgaccagcacggggttgataggaatagcgtttccgggtcataacttctccagcagggaattttatttatcttagcccgacagcatcgcccgacggaatcggaaagaggtaagcggatggtgcgggtttattttccgccgcctacagcgtattgtacgcgcgcctgaataattgagagaacgtatgaaaaagtcagccagcacgtcgcccttccacgcccgcaatcgccatcagggcgaatacgattttgccgcgttaaccgctgcccatccgccgctgaaagccaaagtccggcccaatgggtatggcgtgcagtccgtggatttcgcggacccggaggcggtgatgctgctgaaccaggcgctgatcaaactattttacgacatcgactggcagctggctcccggctcactctgcccgcccgtgccgggacgcgccgattatctgcactaccttgccgatctgctggcgctggataacaacggcgtgatcccgacggcggacgtttctggatgtcggctgcggtgcaaactgcatctatccgctgattggcgcggcagaatatggctggcgctttaccggcaccgaagtcgatgaagccgccatcaaagctgctaaccgtattgttgcggccaatccgcgcctgacgcgccagatccgtctgcgtcgtcagaaaaacagcgatgcagtgctggctggtgtagtcagtaaaactgaatttttcagtgcagtaatgtgtaatccgccgttccacgcgtcggcggaagaagcggtatcgggatcgcagcgtaaggtccgcaatctcggactggataagagtgcgccgctcaactttggcggccagcacaatgagctgtggtatcccggtggcgaaaagggctttatcggcaagatgatcgccgagagcgtggcgtttagtcgtcagatcggctggtttacctcgctggtgtcgcgcaaagagaacttaccggcgctggaaaaacagctgcaggcgctcgacgtggcggagatgcgggtggttaatatggcgcagggtcagaagcagagtcgcttcctggcgtggagttttatgcctgccgcccagcgcactaaactactgagtcgcctggggaactgaggtgtcgctttacatggtaacaggtgtatctgtgggcgaagagtaaaatagaacgggccgcgatgcggcccattttgatcaggagacgtgctgcaggaattcgcgcagacgctcgctcggtgggttgctgatcaggctgtcgggatcgccatcttccgcaatccggcctttatcgataaagatcagccgtgaggccaccttctgtgcgaagcctacttcgtgcgtcacaatcaccatcgtcatgccttcttccgccagatcctgcatcaccttcagcacttcgtgacgcagttccgggtcgagcgctgaggttggctcatcaaacagcatcattttcggcttaactgccagtgcacgggcaatcgccacgcgctgctgctgaccgccggaaagctcagacggaaagtggtgcgcgcgctcggcgaggcccactttgcccagcaactcacgcgccagctggcgtgccgcctctttgctggcaccgcgcacccggataggaccaaaggcgacgttatccagcgcactcatctgtgggaacagatgaaactgctgaaacaccatgcccgcttcctgacgaatcaggcggtcatcgactttcggatcattgacgcgcaggccatcgacaatcagttcgccactggtgatctcttccagcttgttaatgcagcgcagcagagttgatttaccggaaccggatgggccgataatcaccaccacttcgccctggttaatcttcaggtcgatattgtgcagcacctgggtctggccaaaatgcttggagacatctttaaattcaatcacaggattttcacccttttctcaatgcggcgcagcacaaagctcaacaccagcgtaataaccagatagataatcgcgacggcgctccagatttccagcgcgcggaagttaccggcaataatctcctgaccctgacgagtcagttcagccacaccaataacgataaacagcgaagtatctttgatgctgacaatccactggttgcccagcggtggcagcatacggcgcagcgccagcggcataatcacgtagcgcagcgtctcgcggctcgacaggccaagcgccagtccggcttcgcggaagcccttgttgatcgacagcacggcaccacgagtaatctcggcaatgtaagcgccggagttaatcatgatggtcaccaccgccgcgctgaagggatcaatgcgcaggtcggggaaacgccatcggcaaagcaaaatagataaacatcacctgcaccacgataggggtgccgcgaatgatttcgataaacaccagtgcgatgttattggtgatccagccaccgtaagcgcgggcaaagcccgctaccaggccgatgaagagaccgccaaccagtccaataattgaaataattaaggtcagtttagcgccttcaagcagcgctggcatggcgggccagatgacgctccagtcaaactccatggtgtcactccagatatgttgcgatggaaaaaagcagggaaaaagtttccctgctgaaatcagataacgggcaaattattatttaggttcggtgccgaaccattttttatagagcgtgttgtaggtgccgttctctttcagggttttgagtgcgccgttgactttttcacgtaaatcgtcgctgcctttcgggaaggcgataccatactgctgcgcttcaattgaatcgcctaccgctttaaagcggcctttaccggcggtatggatgaagtaaaggatgtttggcgtgtcatgcagcacggcgtccgcacggttagtgcccagctccatataggcgctgtcgatattcgggaaactgacgcagatctttggatttgatgttggctttcgcgtattccacggagccggtgccgcttttcactgcgaccactttaccgttcagatcgctgatgcctttgatgtcgttttcattgttacgcaccatcacctgcagaccgcttttgtaatagccgtcagagaactcaatcgcttttttacgttcttcggtaatggtgatacccgccagtgccagatcgacattgcgcgtttgcagtgcagggataatgccgctgaagtccattggcttcagggtgtaatcgagcttcagctctttcgcaatggcatcccacagatccacatcgaagccgacatatttgtcaccctgtttaaattcaaacggaacaaaggcggtatccgtggcgacgaccagcttcttgtctgctgcagtggaagagagagagaaggccagcgccagcgcggccacagaaacttttaacagtgacttcatcatttttccttttttttactaccaggcggcagggcctgcgtttgcggcttgtcatatgaaagaattatgccaactttgcaaaatccgcgaaatcagagagttaaataacatagctgacacgattttgcagttaattctgccattgcaccagtttggtgctcagttttggtgcaggtggctgttttggtgcaagcggtagtgtgcctcagatgttaaggctgtgaagcggaggagggaagaactgttaacagggtcataaaaatgcggtaacacagacgtaaaaaaggcgggtttccccgcctgacagactgcattgagtcttattcgatgttcgcttcgataaaccacaggaatttatcaaggtcacgtgatgctgcagtgaagatgtcagcggtatcttcgtctttcacttcagtgatcgctttacgggtgtcattcgcgacaacgctgtaacggtctgccagcgctttcagatgatcctgaaacgctgtgaatattcagcggatagctcttcagcggagtcgtatcgttaacgacctgcgtggtgcccagtgccacgccacccagctgaaccacacgctcggcaatagtatcctgatgatcggtaatcgcggtgcggaaaccgtccagcatctcatgcacaccgataaaattagcaccgcgcatgttccagtgcgcctgcttagtgatcaatgacaggtcaataaactcgactaccagacggtttaacaccgcgatggtggcttttttatcgtcttcggccacatcattgcgggtataaatcaggtcagaagatttagttttaaccaatttagcggtactcatcgtttcagtcctctctttgatggttgtcctaatcaagtaccggataagtatagcagcgcttttcaggtttgcagaaacgactttgtcgatggatgaaatagcgtgcgtctttactaaaagcagagctgagctaagaaggttaatgccatgttaaaatataaaaacaaataaatagctatttaaatcatgttgttattctattatgtaaataactggtaagtgtctgtttcaaaataggcaactcaggaaggagcgaagattaggaataattctcatgatgagcatgattattatttagccccgcctgcaggcggggcggatagcgtttatttttggatatcgtctgataattcaacgctgtttaactgactctttttcggccgcatggtcagcgttgaacctgccgaggcgatgatgatcgccagcagcgccagccactgaagcccggtcagggtttcccccagaaacagcatgccggaaaaggcagccatggcgggttccagactcatcagcgtgccgaagatgcgcgccggtaagcgggtgagggcgatcatctccagcgaataggggatggcgctggagagcagggcaaccagcaacgcgatcggcataacggcccatgtccagatgccactttctgcgaaacgtcagccccagcggtacaaaaatcactgaggcaatcagcgacccgatagccactgtcgccgggccatgttctgcgcctgcccgctgtcccgccaggatatagatcgcccagcaggcgcctgcactcactgccagcgcagcgcccagcggatcaatcgcagtcatgcctgtgccaaaaggcagcaggaaccacagaccaatcacggccagcagcacccagacaaaatccagtggccggcgcgatccgaatagcgccagcgccagtgggccggtaaattccagtcccaccgccacacccagcggcacggtacgaatcgccagatagaacgtgaaattcattgtgcccagcgccagtccatacatcaggagtggcagacgttgttcccggctaaagcgtaaacgccagggtttgaagataatacagagtatcagggtgccaaagcccagacgcagcgcggtgatgccggtagcgccaacggcaggaaacaggcttttcgccagcgaagcaccgccctgaagcgacagcatcgcaatcagcagcacggcaatcggcatcactatcggggcaaggtttttagaagcgggagaggcagacatcctgtgtacttttcctggtcatcaacgtaatgagtctgccagtgtaaaggaaatagcaggcaaaaaatcacggaatggagttttaaatttctctcaactgagcgatttttggccagaatcagggccatttaggtaaagaaatgtcaggtttttttaggatttaacttaaagaacgaaatgagcacaaaatgattattgcagaaagatgacggattttataagaaaaatgaatgacataggttgtcgcattaacttcctgttacaccaaacattctgttagacaacaaaatccgggcagagtttctcgctattttttgttatattttcagcgttgtcaggagagaagtattttcacatttgaggtggttatgaaaaaaattgcatgtctttcagcattagcctgtgtactggcagtatctgcaggttcagcaatggcacagagcaccgtaactggtggctatgctcagagcgactatcagggcgtagctaacaaagctaacggcttcaacctgaaataccgctacgaagacggttctaacccactgggttggatcggttcattcacctacacagaaaaagataacaccgattctggcatttataacaaaggccagtactacggtgtgaccggtggtcctgctttccgtctgaacgactgggcaagcatctacggtgttgtgggtatcggctacggtaaattccagcagaaacgatacttcatcacgcgataaaactgattcaagcgacgtaggtttctcttacggcgcaggtctgcagtttaacccagttcaggacttcgcagttgacgttggttacgagcagagccgtatccgtaacgttgacgttggcacctggattgctggcgtaggttacagcttctaagtttagcttagctgacctgcaaaaaagcggccccttgtgggccgttttttattgtgctgatttactcacccttctctcgtgcctgcacgtttcccgactttcccggatcgctgtagccgatcagcagccatgctggttgaagccgcaggtcatattaattcgatggggaaacaggaaaaaaagagagcagaaagggagagtgcgcctctcagccagcggctgaaaggcatagaatcaggattagccgcgccagatcagattctgacagcgacgatcgtcagacttatggcccagcagtttttccagcaacatcagacgcagtgtgaacggtgaacgcgtcagcaggcacagccaggatttcatctccgtggttgttttcttctcagcctggaagcatttactgcaatctaagcaacatttcagggtgctcatagaatcacctcccaatcattgtcgacgcggtagtcagcagcctgcggtgagaggcgtcatcatcaccggagcaacagaggatcaactgggatcgctcttttgctgcttacattatcgtcaaatatagcactggctatatcctttagccaaggctaatgacgaaaaatttgagcttctttgcggctggtttacaatgagcgcagctaaatccgtacagcagtgacagtacgggaaaaaataatgaggaagctgaatgagtcgtcgtgctaaaagcgtggtttctgcgccaaaaggaccactgaaagatattgaagagcatgtcgaaggttttcggcaggtgcgtgaagcgcatcgtcgggaattaattgatgactacgttgagttaatctctgatttgattggtgaatttggcgaagcgcgtcaggttgatatggcggcccgcctgggcgtttcacaacctaccgtagcgaaaatgctgaagcggcttggcagtgccgggctggttgaacaggtgccttaccgcggtgtctttctgaccggtgaaggggagaaactggcagaggagagtcgcgcccgtcatcacattgttgaaagttttctgctggcgttaggcatcagtcccgaaactgcccgacgtgattcagaagggattgagcatcacgtcagtgatgaaacgctggccgtatttaagaaattctccgaaacccgctaacgctaaggcgtaccttcatcatgcctcaactgcttcgatcttttttgcatgactctgttttgcatttattaatcgtgattggtgtagtttctggcatttctggcggattttcgctgggccgatctgcccggtgccgtagactggcataccattattacgctcaccgggttgttgatcctgaccaaagggctggaaaccagtggctactttgacgtgctggggggacgactgattgcgcgtttccggcacgaacgtgcgctggcgctgtttatggtgctggctgccgcgttgctctctacgtttctgaccaatgatgtggcgctgtttattctggtgccgctgacgctgacgctgcgaaagttctctcacttacccatctcgcgactgatcatcttcgaagcgctggcggtcaacgccggatccctgctgacgccggtcggcaacccgcaaaacattctgctgtggagccacggcaaactaagtgttgtcgcgtttattgtgcagatgctgccgctggccgcctggctgctgcttagcctgatggtattaacctggttcagcttttcaaagcggtcgattgataagcatgacaacccggaacagccgcagtggcagaagccgctgtttattgtcagcgtggtgctatacctgctgtttatcgccggcctggagctggaaatcaccggttgggtcctgctgctgattcttgccacgttcctggtgatggcgcgtccagtgctgctgcgcatcgactggagcctgctggcggtgtttatcgccatgtttattgacgtcttcctgatgacgcgtctgccggtgatgcaggctcactttgatgcggtttctcatttcggtcaggggcagctctacctgctggcgattggtctgtcacaggtgatcagcaacgttccggcgacgattctgctgctgcaaaaagtcccgcctggcgatgtgctggcctgggcggtcaatattggcggtttcggcctgctgccgggttcgctcgctaacctgattgccctgcgtatggcgaaagatcgggccgtctggtggcatttccatctcttttctctccctctgcttgcctggtcgatggccagcggctggctgctgttgcggctgctcaattaggcccgacgcatcctgctacccgccacaggtggcaggatgtgcgccatttctcaagtttcgtaaagttgcgctggattttgtcagtttccgatataaggttaacaggacctttatgcccgggaattagggccttagccagtgatgggaactatgagcgagaataaccaacgcgatccacaccagcaggacgcagaaaatgcgacggataaaaaccgtcagtcagaggaaaatcaggacaacgaccagcagcctgagcgtaaacgccccggtaaaaagccgctgattattctggcggtagtggtggtgattatgctgattgtcggcttctggttctggttcactacccgcaatattgaaactaccgacgacgcctttaccgaaggcgatgccgttaccattgcgcctaaagcctccggctatgtcgtgaagctgctggtgaaagataaccagcgggtgaagaagggcgatctgctggtggagatcgatcccagcgacaatcgtgcccagcgtgaacaggctaatgcgcagctcggtttagctgtcgcacagctgcatcaggcgcaggctcaactggcgctgtcaaaggtacagtatccggcacagcgcgatcaggcgctggcggatcaggcgaaagccgaagcgaatctgcttaatgcgcaggcggattatcgtcgccagcgcggcgtcgatccgcgtgcgaccagtcagcgtaatatcgacagcgcgtccgcgcagttacgttcagcgcaggcgcagttacaaagcgcgaaagcacaggttgaagtggcgtcacaggttgctctgcagattcgccagcaggagaccaatgttgaagcgcgtcagcaacaggttgagcaggcgaaggcgcagttaagcacggccgatcttaatctctcctatacccaggttcgcgcgccctatgacgggtttgtcaccaagcgtaacgttcagctgggcacactggtgcaggcgggatcgtcgctgttttcgctggtctcgcctgagatctgggtcaccgctaacttcaaagagtctcagctgcaacacatgaatcctggcgacaaagttgaaatcagcgtcgatgcctggccggatatgaagctggaagggcatgtcgacagtatccagatgggctctggttcacgcttctcgactttcccgtcagaaaacgccaccggtaactatgtgaaaatcgttcagcgcgtgccggtgaaaatcgtcatcgacaagggccttgatccgaaccatcctctgccgctgggtctctctgttgaaccgaaggtaacggtggaatgagtacggcgcagagctggaaacccgccagtaatccgtggttagtggcgatcacggtcacgctggcggtgtttatggagatcctcgacaccaccattgttaacgtggcgctgccgcatatcgccggttcgctctcctccagttacgatgagtcaacctgggtgctgacctcctatctggtggcgaacggcattgtgctgcctatctctgcgttcttcagccgactgtttggccgtaaacagtttttcctgatctgcatcgtgatgtttaccatctgctccttcctgtgcggcatcgctaccgaactgtggcaaatcattctgttccgcgtgctgcagggcttttttggtggcggattgcagccggttcagcagtctgtgctgctggactacttcaaggcggaagatcgcggcaaggcatttgggctctcctctatcgccattattgtcgcgccggtgattggcccgacattaggtggctggattaccgacaactacagctggcgctgggtgttctttatcaacattccggtcggcgtacttaccgtgctggcgatctatcagctgctggaagatccaccgtgggagcgtaaatgggccaaaggtaagctgaagatcgactatatcggcatcagcctgattaccttaggactgggttgtctgcaggtgatgctggatcgcggagaggatgaggactggtttgcctcgcactttatcgtgctgttcgccattctggcgctgattggcatcgtcggtgccatctactggctgatgtatgcccgtaagccagtggttgatattctggtgatgaaagaccgcaacttctgggtcgccgggctgttgatggcggggatggcgatgattctgtatggcagttccgtagtgctgccacagctggcgcagcaggatctggggtacaccgccacctggtcaggtctggtgttgtcgcctggcgcggtgctgattgtgctgaccataccgctggtgctgaaactgatgccaatcgttcagacgcgctacatcattgcctttggctttagctgtctggccgtggcatttctctactccgccaccttaacgcccaacgtcgatttcaccactttggtgttgatgcgcagcgcacagtcaatcgggctgggtttcctgtttgtcccgctgacgactatcgcctttgtcaccattccgcagcggcttaatgctgacgcctcggcgctgtttaccatgttccgtaacgtggccggatcgattgggatttcactctcgaccgctgccattaccgagcgcgaacaggtgcggtcagcgcacatggtgcataacatgacgccgctgaatgagccgttcaacattacgcttcagcactgggcgcaggcgatacgcgactttacctcggcggtgggcgatcccgtcacgctggcaaccggtcagctctatcaggagatgattgcgcagtcgcgtatcctcgcttacatcgatgtcttctcaggcctgagtattgtcgccctgattttgattccattttgttggctgctgtcgccgattaagagcgaaggcagtgcaggagcacactaacatgaaggttttttactctcatcgcctgaaacccctgagtttactgctggccctcgggctggcgggctgcgccgtcggacctgactatcaggcgccgaaacctgccgtgccgggtggctacaacaccctggattcgcaggaggcgtcaaagccacaaaacgccgcgattaattcacgctggtggcgcagcttcaatgatccgcagctcgacagtctgattgagcgcgcgattgcgggcaatctgagcctgcagcagacggtgctgcgcattgccggggcacgtgaacagctgacgcaggcgcagggcagtctgttccccaccctgggcggttcagccaaagtgacgcgtcagcagctcgggctggaaggcttgcttaaatccaatggcgcaaccgatcagctcgacagcaacgtggccagccagctcaatggattgacccagccggttaacctctatcagggcagcttcgatgccagctgggagctggacctgtggggcaaagtgcgccgtcaggttgaggcagctaatgcccagcagcaggcagcgatagaacagcgcaacgatgcgctggtctcactggaggccgaagtggcgcgtgcctggctgcaactgcgtggcgcgcagagcacgattcagacgctgcaacagcagattgaggtggcgcagcagacgaccgagctgacccaaagccagcagcgtaatggcctggccccgctgaccgatgtggaaaatgcgcgtgcccagctcagcacgctgcaggcgcagctgccgcagtatcagtcgcaggcacggcaggcgatgaatgggttagcggtgctgctcggcaagacgccgggggcgctggatgctgaactcagtacgccaaaagcgttacccccgctgccacagtttgtcccggtaggcattccttctacgctggcacgtcgtcgtcctgatattcgtcaggctgaagcgacgctgcatgcacaaaccgctgagattggggtttctgtcgcgcagcttttcccgagcctgtcactgaccggccagctgggcgtgcgcaacaccgatgtcagctatctggataactggagcagccatttctacagttatggcccgtcgttatcgattccgatttttcagggcggacagctggtgtcgagcgtgaagttagcgcgggcacagcaggccagtgccgcgctggattatcgccagacggtgctgacggcgttgcaggatgtggagaatgcgctggtcagctatcgcgccgatcagcagcgggtcaccgcgctggatgagacaaccggtgcgcttcagcgcgcctttgatctcgccagcgacagttatcgccaggggctctcgaccttcctggaggtgctggatgcgcagcgtcagctggctcaggcagaggagcaggcgacacaggcgcggatgcagagtgcactcgatttagtggcgctctataaagcgctgggcggcggctgggagacttaccagaacgtggatatgccgcaatatccggtatttggcccggccacgcaggcgaattagttatccggcggtagctgcctctgcgcagttaccgctttatctctcctccggcagcgttaaaccgatgctgcctttctctccatgttgttcatcatgatctaactcgttgataaagagagcttctcagcatcactggaacgggtgcagccagcagaaaataaaacagtggtaatcgcagggttattatcagcgtctccggcgagcgattaattttatgttgcaggcactttccggattcaggtttttgagctctgtcacctttctcagtttatttctttgacgtttttttaaggcaacttacgactgaacgagtgggggcgcgtgaggctattcagtcagcctgagccgggcggaactgttattgcgcagctaagcgatctgcgaataatccgactctgctataaatcgcagcggcaaaaatggttaacaggtggcaaagggcataattaaaaaagccaccagagcgttaattcttttgcgctatttaacggtgccgggggtggctttttaagcataatctgtaagctggtgtgactggggtcacgggcaggcacatttttaatctgttatctccggcccgtaagcgtaaataatgaggctgcatggcccgcatttagttgatagcgttaactgccttctgccaggataatctgcctgaaatcgttttcaactcctgagtaaaagtgccatttgttgttaattcagcgttaataaaaggtcaggcacgaccgattttaatagctctgtttcggccgaattaatacttaggaattatctgtagcgtaaaaataatttatttttttatttgaattaggtagtcttggcgctacagttttattaaccccccttaatcaaggacattgtgatgagtgacgcatttaaggtactgaacaatattcgcacattacgtgcccaggctcgtgaactgccactgaccgatcttgaagagatcctggaaaaattaacggttgttgttactgagcgccgtgaagaagcagaagcggaagagacgcagaatcgcgaaaaagaagaaaagctttctaaatatcgcgaaatgctgctggctgacggcatcgatcctaatgaattattaggtgcactggaaagcggaaaaaaacgtaccaagcgtgcgccgcgtccggctaaatattcttacaccgacgaaaatggtgagcagaaatcctggactggccagggccgtaccccggcagcgattaaaaaagcgctggattccggtaaaagcctggacagtttcctgatcgattgatcgacacaatccttgtaagtgggagccggggggccatcatggccttccggcttttttatttctgccgggatatcaatcaccccgcaaggaatccacggctgacgctggcgtgcgctgcgtcacatctggcataatagcggccgttttttcatccattctcttcacaaaggtcaatgccgtgttagttagcagcaatatcaccatgcagtttggcagcaagccactgttcgaaaatatctccgttaaatttggcggcggtaatcgttacggtttaatcggtgcgaaacggcagcggaaaatccaccttcatgaagattttgggtggcgatctggtgccttcaggcggcaatgtttcttacgatcccaacgagcgcatcggtaagttgcgtcaggatcagttcgcctttgaacaatttagcgtactggacaccgttatcatgggtcaccatgagttatgggaagtgaagcaggagcgcgaccgtatttattctttgccagaaatgagcgaagaagaggggtataaagtcggcgatcttgaggcactttacggtgagatggacggctatagcgcggagtctcgtgccggtgagttattactcggcgtcggcattccggttgagcagcattatggcccgatgagcgaaattgcgccgggctttaaattacgtgtgctgctggcgcaggcgctgttttctaatcctgatattctgttactcgacgaaccgacgaacaacctggacatcgatactattcgctggctggagcaggtgctgaacgagcgtgacagcaccatgattatcatttcgcatgaccgtcacttccttaatatggtctgtacgcacatggctgatttggattatggcgagctgcgggtttattccggtaattatgacgaatatatgaccgtggcgacccaggcgcgtgaacgtctgttatccgataacgccaagaaaaaagcgcagattgctgacttacaatcgttcgtcagtcgttttagcgccaacgcctctaaatcgcgtcaggcgacatcacgcgctaagcagatggataaaattaaactggatgaagtgaaagcctccagccgtcagaacccgtttatccgttttgagcaggacaagaagttgttccgtaatgcgttggaagtggaaggtttgaccaaaggatttgataacggtccgctgtttaagaatttaaatctgctgctggaagtgggtgagaagctggcggtgatcggtgccaacggtatcggtaaatcaacactgttaaaatcgctggtgggtcagctgacgccagataacggcagcgttaaatggtcagagaatgcacgtattggttattacgctcaggatcacgccgatgattttgccaatgacctgacggtatttgactggatgagtcagtggaaacagcctggcgatgatgagcagaccattcgcggtattctgggtcgcctgctgttttcgcaggatgatattaagaagccggccaaagtgctttccggtggagagaagggtcgtatgctgttcggtaagctgatgatggaaaaaccgaacattctgattatggatgagccgaccaaccacctcgatatggagtcgattgaatcgctcaatatggcgctggagatgtatgaaggcacgctggtgtttgtttcacacgaccgtgaatttgtcagctcgctggcaacccgcgtgatagagctgaaagcagaccgcgtggtggacttcaccggtaattacgaagattacctgcggagtcagggtatcgtctgattgaaacggggtggcgcaggccaccccgttttttttggtggtttgttggttcagcacgggcttcagggagcacaggcgttcctgccgacgctacgcgctaccaccacacacttcacagtgcgcatcctgcgccaccttcatgctgcggaactccgcgctcatcgcatcgtacatcagcaaccggctggtggcgggcgtgccaaatgccgtcagcactttaatcgcttccatcgcctgcatcgcaccaatcacgccaaccagcggagccatgacgcccgcttccacgcaactcagggtttgttccccaaacaggcggctgatgcaacgatagcagggtgtgccgggctgccagttgaatacgctgatctggccttccatccgaatcgcggcgccggagaccagtggcacccgctgctgacgacagagccggttaagctgctcacgcaccgcaacgttgtcggtgcagtcaagcaccacctgctgccgggcgatcagcgccagcagcgctgcatcgtccagctgtccattgaccggatgcagctgacagtgcggattgatggcggccaggctttgtgcggcggagtccactttggcacgaccaatatcagcatcgtgatgcaggatctgccgttgcaggttagagtgcgatacggtatcgaagtcgagcagcgtcaggctaccgacaccggcagccgccagatagggcgcagccgcgcagccgagtccgcccagccccacgaccagcgcgtgactcgctttcagccgctcctgaccgtcgaaatcaaagccgcgcaatacaatctgccggttatagcgcagcatctcctcatcgcttaattcaggcagcatttacgcctccagcagggcgttgaacggttccacctcgacccattcgcccggttcaacattgccgcgatcccgttccagcacaataaaacagtttgcctgggcgaaggagctgaagacgtgcgaaccctgcatcccggtggtttccacctccagtttcgccctgtgcgttctgtcgcaggatgccgcgctggaaatcgagccggccaggtgactttttcagccgcgaggcgcagcgcactttctgacgtggtggcaatgctgatttttgctggccggtgagggtggcaagcagcggctgaacgagctgataaaaggtcacggcggcggagaccggattacctggcaggccgcagaaccagctgctgttgaggcggccaaaggcaaatggcttgccaggcttgatcgccagcttccagaagctgatggcaccaagctcttccagcatcgttttggtgaagtccgcttcgcccaccgagacgccgccggtagtaatcacgacatccgcctgccgatcggcctcggtgaaagcagcacgcagtgcggccgggtcatctttgatgatgccaaggtcgatgacttcgcaacccagcttatgcagcatcagtgataccgcaaagcggttggtgtcgtagatctggccttcggccagcggctcgcctaccggctggagttcatcaccggtggagaagatagcgacccgcagttttcgcagcacgctgacctgcgcgatacccagtgaggcgagcagtggcagctctgccgcgcccagccgcgttcccgcttccagcaccacggtgcctggctgaatatcatcgccgatgagacgaatgttctgtccgggacggaccggcgcggtgatcacaatcgcatcaccctgtgtttcggtctgctcctgcatcactactgcttcacagcctgcaggcaccggcgcaccggtcatgatgcgaatcacgctgccctgtggccactcaccgctaaacggtgcgccggcaaaggctttacccgccactggcagcggctgaccgctgctggcgtctgccagcctgacggcgtagccatccatcgcagagttatcaaatggcgggacggcaatcggtgaggtcaccgctttggcggtgatacgcccgaccgcttcggccagcggcacgctaagagagtcggtgacgggcgtcagctgtgacagcattttttgttgtgcctcctcaagggagatcaagcctgcagtaaaactttccatggatattccagcctggttatctcagatgctgcctattatggtgggaattagccgcttagtcacatcggtgtcggcctgacttgcctgttgttgtggccaaagtgaaatatggcggtaagaaaaggttataaccacaggaacagtttccgctttacaacacttagcaggctttctatagtcaaaaatcaccaaaaatgggtgaaaaccattttaaatcagtgtttttcgtcctgatgcaaccacagggtagatcgttatggtcaatgcagtgatcgccattcatggaggcgccggtgccattacgcgctcagcaatgagcgccgaaaaagagcaactctatcgtcaggcgctacacgatattgtcactcagggccagcagatactggctcagggcggcagcgcactcgatgcggtgaccgaagcggtgcggctgctggaagagtgtccgctgttcaacgccggtaaaggcgcggtcttcacccatcagggaacccatgaactcgatgcctgcatcatggatggccgcacgctgggtgcaggggcggtcgcgggcgtaacgcgggtacggaatccggtgctggcggcacgtgccgtgctggaacatagcgagcatgtcctgtttatcggcgagggcgcagagcagtttgctaaagcgcacgggctggaaacggtcacgcctgattacttctcgactccggaacgctgggagcagttgcagcgcgcgctgaacagcgatacggcggtgctggaccatgatggtgccgcgcacagcgatgacccgctcgacccggaccgtaagtttggtacggtgggggccgtcgcgctggatcttgagggcaacctcgcggccgccacgtcaacgggcggtatgaccaacaagcaggccgggcgggtcggcgactcgccgctgccgggcgcaggctgctacgccagcaacgacagcgtggcggtctcctgtaccggcactggtgaagtctttatgcggacgctggcggcctatgatgtggcagcccagatgcgctacgccgggcgctcactgcagcaggccacagttaatgtcattcatgacagcgtgctggagctgggcggcagcggggggctgattgccgtcgaccgcgcaggcaacgtagcgctgccgttcaacagcgaagggatgtatcgcggtgtggcgcgggttggcgaagtggcagacgtcgctatctatcgcgaaagttaaggagcagagatgagcgacaggcaaacgttaccgccgctggcccctgagcaggtcctggcggtgcgcgatctcaatgtgcgttttcagcacgaaaccaccgtcactgacgcggtgcgtcatttgtcactcgatctgtttcgcggcgaaacgctggcgctggtgggggagtcaggctcggggaaatcagtgacctcgctggcgctgatgcggctgattgagcaggctggcgggagggtcagcggcgaggtgctgttgcggcgtcgcaacggcgacgtgctggatctgatgcgcgcctcaaaaggtcagatgcggcgggtgcgcggtgcggatatggcgatgatctttcaggagccgatgacctcgctgaatccggtcttctccgtgggcgagcagattgcggaatccatccgtctgcatcagggcctgagccacgccggcgcgctggccgaagcgcgccgtatgctggatctggtacgaatccccgatgcgcaaaatgtattatcccgctttccgcatcagctgtcgggcgggatgcgtcagcgcgtgatgatcgccatggcgctctgctgcaaaccggccctgctgattgccgatgagccgaccaccgcgctcgacgtcaccatccaggcgcagattctgcagcttatccgcgtgctgcaaaaagagatgcagatgggggtgatttttatcactcacgatatgggcgtggtcgccgaaatggccgatcgggttcaggtgatgtatcgcggcgaagtagtagaaaatgccccggtagccaggctgttcagcgcaccgcagcagccctatacccaggcactgctggcggcggtgccaaagctcggttcgatgcagggccagcccctgccggccaaatttccgttgctgcacagcgatgccgttgatgacgtgccgcaggatacggttcgccgcctgcagccacccattttgcaggtgcgcgatctggtcacccgctttgatattcgcggcggcctgctgaaccgcgtcaaaagccgggtgcatgccgtcgaaaaagtcagttttgatctctatgccggtgagacactggcgctggtgggcgagtctggctgtggtaaatcgaccaccgggcgtttcgctgctgaagctggttgccagtcagggtggcaccctgacctttgacggacagcggatagaccatttgtcaggtgccgcgctggcccatctgcgacgcgacattcagtttatcttccaggatccctacgcctcgctcgatccccggctgacggttggcttctccattatggagccgctgctggttcacaaggcgatgccgcgtcgcgaggcggagcagcgcgttgcctggctgctggataaagtgggtctgctgccggaacatgctcagcgctatccccatgagttttccggcggccagcgtcagcgcatctgtatagcccgcgcgctggcgctaaaccccaaagtggtgatcgccgatgagtccgtctcggcgctggatgtgtcaattcaggcgcagattattaatctgatgctcgacctgcagcgcgagtttggcatcgccttcctgtttatttctcacgatatggcggtggtggagcgtatcagccaccgcgtggcggtgatgtatctcggtcagattgtcgagatggggccgcgtcaggcggtgtttgagcagcctcagcacccttatacccgaaaactcatggcggcggtgccggtagccgatccggctcaccggcgtcgcgaacgagccttactggtcgatgagatccccagcccgattcatgcgttaggggatgaacctgaagtggcgccgctgatggaggtggctccgggccatttcgtcgcccgccacgttatcagtgcgacctgaacagtgacgatgtcgccccggcgaccaacccgacagggattacaggagaacaagatgcagattacgatgcgtaaagggttactggcggctggcgtgttaagcagcgcaatggcattgcccgcctgggcagcacaggatgcggtgattgccgtcgcgtccaacttcaccactctcgatccctatgacgccaacgacacgctgtcgcaggctgtcgcgaaatccttctatcagggcctgtttggctttgataaagagatgaagctcactaacgtgctggctgagagctatcaggccagcgccgacggcctgacctacaccatcaagctgcgttccggggttaaattccaggatggcactgacttcaatgcggaagcggtaaaggtcaacctcgatcgtgccagcaatccggataaccatctcaagcgctacaacctgtttaaacatatcgccagcaccgaagtggtggatccaactacggtaaaagtaacgctgaaagagccgttctccgcctttatcaacattctggcccatccggcggcggcgatgatttcacccaccgcgctgaaaaaatatggcaaagagatcggtttccatccggtaggaaccggcccgtttgtgttcgaaacctggaaccagaccgattttgtgaaggtgaaaaagtgggacggctactggaagccgggctatccgaagctggacagcattacctggcgaccggtggtggataacaacacccgcgcggcgatgctgcagaccggcgaagcgaactttgctttcccggtgccctatgagcaggcaaaactgctggagaagaacagcaagcttgctgtggtaaccacgccatcgattatgcagcgttacatcagccttaacgtcactcagaagccgttcgataatccgaaggtgcgtgaagcgctggaatatgccatcaaccgtcaggcgctggcgaaagtggcgtttctccggttacgccacgcctgctaccggcatcgtgccgcccaccatcgacttcgctcagagctatccggccatcagctacgatccggccaaagcgaaagccctgctgaaagaggcgggttacccgaacgggtttgaaaccacgctctggtcgtcacacaaccacagcaccgcgcagaaagtgttgcagttcacccagcagcagctggcgcaggttggcgtgaaagttaaagttacggcgatggatgcgggtcagcgtgccgctgaagtagaaggcaagggccagaaagagagcggcgtgcgcatgttctacaccggctggtccgcctccaccggcgaagcggactgggcactgacgccactgtttgctactacggcctggccaccggcgatcttcaataccgcgttttacagcaatcctaaggtcgataaagatctggcagatgcgctgaaaaccaccgatcgtgccgagaaagcgcgtctctacaaagatgcgcaggataccatctggcaggatcacccatggatcccactggtggttgagcagctggtttctgccaacagcaaaaacctcagcggtttttatgtgatgcccgatacctcattcaattttgatgaggcaactctgaagtaacggagccggccagcccgcgaggctggccgcagctgcaggatgttgcatgtttaactattttctcaaacgactctttgggctgatccccacgctgctgattgtggcggtgctggtattcctgtttgttcacctgctgccgggcgacccggcgcgtctgatcgccgggccggaagccgatgcctcggtggtggcgctggtgcgtcaggagctgggactcgacctgccgctgccgcagcagttctggcactttatgctgaatgcgctacagggcgatttcggccagtcgatggtctcgaagcggccggtcgcggaggagatcgcctcacgctttatgccaactttgtggctgacgctggtcagcatgatctgggcagtgatttttggcatggcaatcggcatcgtttctgctgtctggcgcaatcgctggcccgatcgactggggatgacgctggcggtgtcgggcatttcgtttcccgcctttgcgctgggcatgctgctgatgcaggtcttctcagttgaactgggatggctgccaaccgtcggtgcagagagctggaaacattacattctgccctccatcaccctgggtgcggcggtggcggcggtgatggcgcgctttacccgtgcctcgttcgtggaggtgatgcaggaagattatatgcggaccgcccgggccaaaggggtgcgcgagtcgctggtggtggtgaagcatggcctgcgcaacgccatgatcccggtggtgacgatgatggggctgcagtttggtttcctgctgggcggatcgatcgtggtcgaggtggtatttaactggccgggcctggggcgactgctggtcgattccgtggcgatgcgcgactacccggttattcaggcagaagttttgctgttttcactggagtttattctgatcaatctgtttgtcgacatgctctatgcggtgattaatcccgctattcgctttaaggagtcgcgatgaaaaactggcgacgcgaagcggcactgaaaacgatgccgctgattgcggagaatcgggtgcgaacgccgtggcgtgaattctggcggcgtttcagaggacagccggtggcgctgctggccgggctgtttgtgctggtactgattgtgctggcggttatcgccccatggattgcgccgttcgacgcagagaactacttcgattatgaccggctcaatgacggcccctcgctgatgcatctgtttggcgtcgattcgctggggcgtgacattttcagtcgggtgctggtcggcacgcggatttccctgattgcgggcttcttttcggtagtgatcggcgcgctgatcggtacattctttggtctgttagccggctattacgaaggctggtgggaccgcatcaccatgcgtatctgcgatgtgctgtttgcctttcccggcattctgctggcgattgcggtggtggcgattatgggcagcggcatgagtaatgtgattgtggcggtcgctatcttcagtatcccggcgtttgcccggctggttcgcggcaatacgctggtgctgaagcatcagacctatattgagtcggcacgcagcatcggcgcttctgactggactatcatgatgcggcatatccttcccggcacggtatcgccgattgtggtctatttcaccatgcgggtcggtacctcaatcattaccgcggccagcctgtcgtttctggggctgggcgcacaaccgcctacgccggagtggggggcgatgctgaatgaggcgcgggccgacatggttatcgcgcctcacgtggcgattttccccagcctggccatcttcctcaccgtttctggcatttaatttactcggagacgggctgcgcgacgcacttgatcctaaactaaagagatgaaacctttcgattatgatcaggacttcagcactatcgacttccgccagcaccccgagctttatcaggtcgggcgtggtgagcagggtgtgctgatggtcgagccttataaaggcgaaatactgccacactggcgttttcgtaccgttcccattgctgaagagtcggctgagaaaatcatggtgctgtttgaggagtatcggcgcaaagatgattttgtcggcatggatatggcgcgcaaatttattcagatggggtatacccgtgcgcgccgttacagcaaccacaagggcggacgcaaatatgacgcggatggcaaggagctgccgcgcggcgtcaacgaggaaaaagccgcggcggcggctgttttcaaaggctactgggacaaacttcgtgcagatgaagactatctgcgacgtaaaaaagcgcatcagcagcagtatggctaagcgttaatcctgctctcccggcagccgctaacccctgctgccggggttattttaatgaacccgtcctgctcaatcttatccctcattccttgctgcaacggttctgctgcagcgcccgtgctgccagatgcgcagccgtttcgccatgccctaaaacgccatagcccgccacgcttgccagataaggtcagacagcagcagaagagaaaccttttctgctggcgagccgggggcgtaaagtagtgaaaaaacgcgtaaaagccgatccacagcacaggcaaaaaaacgggcggttcaaaccgtgctttttccaataacttcccgtgctataaaaagaaattggctgcggagcctctgactgatgaacaagcgaaacgctgacagtggccgttgtttagagcatccggtaaaaggcgggttgatattcacttgttttcattaataataaacgggcaaaccccactgagggggctatgcccctcaggtaatgaaatggataatgtgagagctaaataatgaaagagatcatcaacggatttctgaatttccagcagaatgtgtttcctgaaaggaaggatcttttcaaaagcctggcatcaaatcaaaatccgaaagcgctgttcatctcctgttcagacagtcgtctggtgcctgaaactggtgacgcagcaggagccaggagagctgttcgttatccgcaatgcgggcaacatcgttccctcattcggcccggagccaggcggtgtctccgccactatcgaatatgcggtggtcgcgctgggcgtctccgacatcatcatctgtggtcactctaactgtggtgccatgaacgccatcgcctcctgcgcctgcatggataccatgcctgcggttgagcactggctgcgctatgccgatgcggcaaaagcggtggttgagcagcgtgagtatgactcaccagagaagaagctgaacgagatggtcaaagagaacgtcatcgcccagctgaacaacatgaaaacccatccttccgtctccgtcgcgctgcgtaacggtaagctgcgtctgcacggctgggtttacgatatcgaaagcggcaccattatggcgctgacccagggtggcaaacagttcatcaccctgtctgagaatcctgatacctgctttgagtaatctttttcgcccgctgtgctctgcagcgggttttcctgctatttattctgcataacagcgttaaatcgcctctgttattctgcatttcccctctggcttatctatgcttgcttaaaccttcctgatacaagcgagttgatgatgcgtaaaacttccgttgctgctcttctggcggtctctgccgtgctgctcagtggttgtacttctcatgttgctgataagcagcaatattcaggttttttaagcgattacagccagttgcaaccgacgtcgtcagccagtggtgaaccgactctgcgctggatatcacccgactatcaaagcagccattataaagatgtgctttatacatcgctggtctactacccggcggcgcaccccacgccacgcgtcactcagcaaacgctggatcaggtgctcagttacaccgagatccagctaaaaggcgcgatagccacccgcctgccgctggtgaatcaggctacgccgcataccctgaaggtaagggccgccattaccgccgtgtcagcagaaaatcagggcgtgcagttttatgaagtggtaccggttgccgcggtcgttgccagcaccatggcggcgtcagggcatcgtactcagaacagcgaactgtttctggaaatagaagccaccgatgcggtgacgggcaaaccgatgatccgggtggttcgcaaagcctttggcaaaacggtcagtaacagcaatacgccgatcacctttgacgagctgaagcctggtatcgatacgatggtgcgtgacacggtaagttttaacgcgccctgactctgacgggcgacagcagagcgctgtcgccctgattaatcttttgtaaatcctcaacatcattgcagaggggctgactacgcttaagggcattctatcccgtcaggagatcgttatggcccgtttctcaactgctttgttgctaagtggctccctgttctgtaccgcccccctgtttgccgccgacgtaaaggtcgaggtattacaggataagttacaacatccatggtccgtcgccttcctgcccgataacaaaacgctgctgattaccgaacgtagcggacaactgcgcagctggagcccggagagcggcctgtcgcagccgatccagggcgtgccaaaggtctgggcagaaacggcagagtggcctgctggacgtcgtgctggcacccgattttgccaccagtcgccgcgtctggcttagctataccgaagcgaacagcagtggcaaagcgggcgcggtggtaggcgtgggcacgctgagcaaggataaccggcaactcagcgatttccgcgaggtgattcggcagacgccgatgctctccagcggcaacaacatcggtacccggctggcgtttgatacccagggctatctctggatcgccttcggcgataattttgccagcagcgctgcgcaggatctcgataagctgcagggcaaactgctgcggctcaacgccgatggcagcgtgccggacgataacccgtttgcgaaacagcgcggcgcacggccagagatctgggcctttggtttgcgtaatccgcaggggctggcgcttaacccctggaccggcaagatatgggaaaatgaacatggcccgcgcggcggcgatgaagtgaatatcatggagcggggcaagaattacggctggccgctggcaacctacggcatcgactatagcggtgacaaagtgccggagtcacaaggcacacaggttgcgggtaccgaaccgccgctttatcactggaaggattctcccgccatcagcggcatggcgttctacaatagcgcccgttttccgcagtggaaaaactcgctgtttatcggcgctctgaaagagaaaaacctgattcgtctgagtatcaacggcgagaaagtggtggaagagcagcgtctgctggacgatcagaaggcgcgcattcgcgatgtgcgtcaggggccggatggctggctctatgtgctgaccgatgaggccaatggcaagctgctgaaagtgggattagcgcaggacgctggtgcgtcccgcggctaagagcctgtccccgggctattttatgtgtcagtctgggcctgggcagtgctcacacaggctgctttagcaacctgaacgcccgtcagggcggccctgaaggggcgagcgcagcgagtaatcctcacggactacgtgtactacggattgtgccgcgctgcccgtgtccaggctgccagcaatagttaccccagatggaataagctctgagtcagcgcgcccagtgataaacctgccagccgcggtttaacgcttcctggtgtaagtgttcgtcagggttgatgacatgggcatgatcggcctgttccagcagcggcaggtcgttcatcgaatcgctgtaggcccaggtgcggtcaaaggcctcgtcctgctgcagcgctttccagtcacccagtcgcgtgactttgccctctttataggtcatggtgccgtaagtgttgccgctgtagcgctcgtccacgatttcaacgccaatcgccagcgcgccgcaggcacccagcttctctgcaatcggcaccaccagatgctcgccgctggcggagatgatcatgaccttgtcgccacgcgcccggtgccactcaatccgctcgcgggctgcaggataaacgcgtggcatgatgtcgcggtgaatgaagcggcgcacccagccttcaacggtaagcgtggccatgcccgccaggggggagagtgttttattcatatactcttcaatcgacagcgtaccggcatagtactggctcattaatgcctgttcctgatcaatcagttcactgggggcgaatccctgtgataccagccagcgcagccacaggctggtgctgtcttcacaaatgagtgtttcatccagatcaaaaagggctaagtccatggtcggtctcctcggctgactggcgttcaggttaactgatatttgtgacgggcttaactcttctgcgaaaaatcggaatttcacgcagttttcatagcgacagaatcggggaaaagcggcacgcgcgcggcacttatgccagggttactctactaaactctaaaaaactttacgattcgacggttttttttcgctgccgtcaagggttagcgtttgagtgagaattttctgcccctggaatttcgatttaacaaggacaatccggccaagcccatgacaaacactcgcttcacatctcgcctgcggcaccttgctgccacttcattactgattcttgcccccgtcagcgtttttgctgagcaggctcccgccgcgccaggcattgatgctaaagcgtggattctgatcgactacgccagcggtaaggtgttaaccgaatccagtgccgatcagcgcctcgaccccgccagtctgactaaaatgatgaccagctatgttgtgggtcaggcgattaaagcggggaaaatcaagccggatgacctggttaccgtcggacaggatgcctgggccaccggcaaccctaagctgcgcggctcgtcgctgatgttcctcaagccgggcgaccgtattccggtgcatgagctgaataagggaatcgtgatccagtccggcaatgacgcctgtattgcgctggcggattatgtggcgggcagtcaggattcgtttatcggcctgatgaacaactacgtgaaggcgctgggactacagaatacccactttatgacggtgcatggtctggatgcagaagggcagtacagtaccgcgcgtgacatggcgctgattgctcaggcgctgatccgcgatgtgcccgaagagtacgcgctgaataaagagaaagagttcaccttcaataatattcgccagatcaaccgcaaccgcctgttgtggagcaccaatctcaaggttgatggcgtcaaaaccggccacacctcaggcgcggggaataacctggtcgcttcagcaaccgaaggggatatgcgtctgatctcggtggtgctgggcaccgccagcgatgcgattcgtttccgcgaaagtgaaaagctgctgacatggggcttccgtttctttgaaacggttacgccgattaaagcggatgcgccgtttgcgcagcagcgggtctggttcggtgatcgcagccaggtcaatctgggcgtggcgaaagatgctgcgctgaccatccctaaagggcagatgaagaatctgaaggcgagtttcagactcactacgccgcagctggaagccccgctgaagaagaatcaggtggtcggcaccatcgatttccagctggacgggaaaaccattgagcagcggccgctggtggtgatgcaggatgtgccggaaggcgggttcttcagccggatgattgatttcgtgatgatgaaattcaatggctggttcgggaagtggttttcataagtaagcagggacgctgatatgttcctctcagacgagcgctgtttctaaaacaggatctaaccgcaacgcattagctcagcgcgcagggagctgggtcagaagaggaaagcgtcccgcgccagggatggcgcgggccgagcatgccatggatggcggtttttgcgtctttccgatctgacccagttccctgcgcaggctcgatctcaccgctgtcaggtgcagtttttttccgacagcttcagggacgctaacgcgtccctttcttaatcctgcgtccagcctttgcgaatcggcacggcaaacagcgaccgatagagtggattgattaccgccagcatccgctcgccatagaactgccacgccagatgcgaagccagacagctcagcagccccaccaggaacccgcccagcatatccattggccagtgaacgccaaggtagacccgcgaccaggcaatagcgcaaccggccaccatcagaaccacacctgaccagaggcgatgccagaagataaaggccagtgcaaaggtgaatattgtggtgccgtgatcgctgggataggagtcatcggcggcgtgatgcaggaactgataaccaaaaccgatagcgaaagggcggggatgcggcaacagctggcccacagaccaggagatcgccagcgcatagatcagcgccataccggttttcagtaccagcacccgctgcgaagacacctgatcgcgcggtccccagagccacatcgccacgattaacagcggcacgatggcgatcagatctttggcaaaaaacgtcgccagctgcagtaaccaggcgggtgaagccggtgtggcattaatggcagtaaacagtgaatggttcagctcttccatttcgggataaattcctcagcagacagtccggttaacggcagctggcagcatcccgccagcccggtccgataacagcggcaaaaaaaacggtcagcgacagcacgctcacccaatcagtcagcacaaattgctaactaaacagcggtctatcctgctttttaccgttttgttcgtctatagaaaggctcttaatctgccgttgagttgtgtaacggtttaagttttatgacacttgaagttgcgaatcaggcggggaatgacggggagggacgaaaaaaggcataaaaaaacccgccgggaaaaagaccagcgggctccacaatttggggatttcaaagaaaagcagtggcacttattatgactatcccttaacaataaagttctggacgcaggcaaaaaaattttataagggcaatatcggccagataatcacaatcagcgttcccgccagcgtcagcaacacgttggcgatggcataggtcccggcatagcccagcgccgggatattgctgcgtgccgtatcactgatgatctccatggccggtgcgcaggtacgtgcgcccatgatggcgccaaacagcagggcgcggttcatccgcaacacataagcaccaaacagatagcagatgatcaccggaatcaggctgaccagcaggccgcacagcagcatcagcgcaccatcgctgctcaggccatgattaatgccgctaccggcactcaatcccactcccgccataaacaccatcagaccgaactctttcaccatagtgagcgcgccctgcggaatataaccaaaggttggatggttggcgcgcaggaagccgagcatgataccggcgaaacaggaggcccgcggcgttaccaataccaaaactgaaattgctgaactggaaggtgatcagaccaatcatcagacccacgataaagaaggcgcagaaggctaaaagatcggtcatctgactgtgaatcgcgataaagccaatgcgatccgccacgcttttcactcgtcgtgcctcgccgctgacctgcagcacatcacctttgttcagcatgatactgtcgtcgatcggcatctcaatctggctgcgtatcacccggttcaggaagcagccgtgatcggtgaggtttaacttgctgaggcgtttgtttaccgcattgtggtttttcaccacgatctcttcagtgacgatgcgcatatccagcaggtcgcggtcaaaaacctctttgccgttgcggaagctggggtcgagccgggcgtgagcatcgggatagcccaccagcgagatatcatcaccgagctgtaacaccgcatcgccatcgggactggcgagaataccgttgcggcggatgcgctcaatgtagcaaccggtctgacgatagatacccagttcgcgcaggtttttgccgccgctccatgccaccagttccggaccgacgcgataggcgcggatcaccggcaggaaaactttgcgctggctgtccgcatccagaccgcgttcccgggcgatctgctgggcgcaggtgggcagatcctgatgttgcagacggggcagataacgtgcgccgaaaatcagactgaccaggcctatcagataggtcacggcataaccgaggctcagctgatcctgcatcagtccaagctgtttcggatcgctgatgctttgccgcagggtatcgcccgctccgaccagcaccggcgttgaggtcatcgacccggccagcatgccggcggtgagaccgatatcccagccaaagagtttgcccaatcccagcgccagcaacagtgcgctgaccaccatgacgatggcgagcatgaaatagtttttgccgtcgcgaaagaaaatggaaaaaaagttgggaccggcttcgacgccgacacaaaaaataaacagcataaagcccagactcaatgcatcggtattgatcgtaaagtgctgctggcctaataagagcgaaaccactaatacgccaatcgaatttcccagctgaaccgagcccagacgcaacttacccagacagaggccgagcgctaaaacgacaaacaataacaaaatgtcatttccgcttaacaatcctgcgacgttaatattcactgtttaacttcttgtttacatgtaacctattgaagagtagcctgtttttcgctatcgtgagcaggccgttgaggtgctgttgcatcagtactgcaaatggaacctttaccgcggcgctattctaatcacaaatatctttcacagccattggctgttttcattcgttgccacagcgaactgtttctttttatttccatctgaacgcatcagggttatcagcaggttattgtcggggttacttttaatcagtggggtggtatgccgcagcgttcttatctctggactacccgcctgtgcggcgtggtgttgtacagtctggtgtttgtctttacctgtcatttctggcaggtcggtcccggcccgcttcgtggtcagcccgaattactgctctttatgttgcccggtattgtgatggcattggtgcaggtggagagcccgctaaaaagcaccctgctgatggggctatggggaacgttactggcagcactgctgttaaacagcagcctgtttatccacagcaatgcactttttgtggtcgcatggagcctcagcgcgctgtttctgggcaggctgcggggctttgctggtacggttgatgcagatagtgatggcatcactcaattaaacagtgttgggcgatggatgaccggcagagcgcaaaaaaggcgagacaggaaaatcctggctcgcctttttcattccggctatcagcgcttacgcggcaaatcccagattctctttggtccaggccgcaaactcggtgtagccaccgatatgtttttcgtcgacgaaaatctgtggcacggtgctgaccggtttaccggcgctcgcttccaggtcggctttagtaatgccttctgcgttaatatcgacatactggtagctaaaatcatcacgttcagcggttagtttgtcggccagttcatgggcacgcacacagtagggacagcccggacgaccaaaaataacagcaatcattgagaactccttgcagcgactattatgtgatgtgtatcacacaatgaaacagagaatggcaaccatgatgcccgctcgtatcgcttaaggaaagcaggatttgcctgttagtctgatgcccgcacgctatcgctgcccggtcaggaagcctctgaatcagaggctttttcgcgccggcagcccgtgtatctcgcgcaatttttgggttgttgaccataattgacgctcagtcagccgctaaggcaggaggatatcatgcagagtgtagccagattaccccggtttgtggtggtgctggaggcggctggcggcctgttaatcgtggccgcgctgctgctgatcaaccactggcttccgctgccagacaaggcggatgtaaaaacgctggccactgtgctgtttattgctggcgtggttctgatgctacctgctgcctggctgttaatgtggcgcaccgcgaaagcgatagcaccacagctgtttaatcaaactgacaaaaaaagataatattgctggagactttatgacaccgaccattgatttactgtgcagccatcgttcaatccgcgcctttactgatcagccggtcagcgaagcacagcgtgaagcgattattactgcggcgcaatcggcgtccacatccagttttttacagtgttcctccattatccgtatcaccgataaagccctgcgcgacaagctggtgacgctgacgggcggacagacatgggtcgcggatgcgcctgagttctggatcttctgtgctgactttaatcgccacctgcagatttgccctgatgcgcagctgggtcgtgccgagcagttgctgctgggctgcgtcgataccgcgctgatggggcagaatgccatggtcgcggcggaatcgctggatctgggcggcgtctttatcggcggaatccgtaacaacatcgcggaagtgacagaaactgctgggcctgccgaaatttgtcctgccgctgtttggtttttgcctgggtcatccggagtcaaagccggacgtcaaaccgcgtatgccgcacgcgatgctggtgcatgagaaccgctatcagccgctggatccggcggtgctggccgaatacgatagccgcacagaactctattatcagcagcgcggcagcaaccagcgcagcgaaacctggagtgagctgatccagcgcctgatcattaaagagacgcgtccgtttatgctcgattatctgcatcagcagggctgggccacgcgttaagccagtaagggagagcagcgatgaagatagctatcctgtcgcgtgatgagacgctctactccagtcggcgactgcgtgaggaggccgccgcacgcggccaccaggttcagatcatcgatccgctctcctgctatatgaatattaatcccgcctcaccagcggttcactactgtggtgaaccgctgggccattttgatgcggttatcccgcgcatcggcaaccctatcactttttatggcacggccgtgctgcgacagtttgagatgtgcggcagctatccgctgaatgagtccgccgccattacccgcacccgtgacaaattgcgctcgctgcagctgctggcacgggaaggcatcgacatgccggttaccggctttgcctcctcacccgatgacaccgctgatctgatcgccctggtcggcggtacgccgctggtggtcaagctggtggagggcacccagggcattggcgtggtgctggcggaaacgcggcaggcggcagaaagcgttatcgatgcctttcgcggcctgaatgctcatattctggtgcaggagtttattaaagaagcgcagggtcgtgatgttcgctgtctggtgattggcaatcaggtggtggcagcgattgagcgggtggcgaaagagggcgactttcgctctaatctgcatcgcggcggcaaagcttatcccgtcgtcattacgcaacaggagcgccagatcgccgtgaaagcggcggctacgctcgggctggaagtggcgggcgtcgatattctgcgcgcccatcgcggcccgctggtgatggaagttaacgcctcgcccggtcttgaaggcattgaaaccagcagtgaccttaacatcgccgccctgatgatcgaacggattgagcagcaggccatccccgggctccgtcctaaaaccgctggctgacacgcgcttttcagcggttttcatggcatcgtcgcgcatttttccgtaagctaagtcgcctgtttatcaccccactgggattttacgatggattctcttgtcgttccggatatcgacctgctgcgtcgctggctggatcagcaaaatatcacctggttcgaatgcgatgcctgtcaggcacttcatctgccgcacatgcaaaacttcgatggggtgtttgacgccaaaatcgatctggtcgacaacgtcattctgttttcggcgctggctgaagtgaagccgacggcgctgattccactggttggcgatttgtcgcagatcaatgccagttcgctgacggtgaaagcatttatcgacattcaggatgataatctgccgaaactcattgtctgtcagtcaatgattaccaccgccgggttaacctttggtcagttctcgcactttatgaaacagagtgaagagcagatctccatggtgatcctggaagcctttgccaacaatctgttgatcgtgggcgaagaagaagagcacgtttccggtgaccagcgttcattctgtgctgcactaagcccgacatggtcacacactaagccgtccctgagacggcttttttatgcccgccatccgctgccgcgataattttttattctgcattttgccctttaacgccagatattagtcgtggtttatgccatcaaagccgaacctcatagctcaaacatgcataaaatatcgctttcaggcgttttttacgctggggtctggtgaagcctgaccgggggggctatgcttgcggggctgtaacaggcgcgtaactgcgcctcagctataggtttttgctattaaactcccgctgaataatgattcattgtgtcactgacgtcttgtacagaacgcaatgcagggatctctggtttgcagcgttgtaatgacccgctcaggaggatggaaaaatatgttcaactcacgtcagaaatggctgtcagctgtggtagctgctgcgctgatggccgcatcggccagcagcatggcggaagataaaacgctgcacgtctacaactggtccgattatatttcgccagataccgtgccgaactttgaaaagcagtccggcatcaaagtggtctacgatgtgtttgactccaacgaagtcctggaaggcaaactgatggcgggcagcaccggctatgatgtggtggtgccatcctccagcttcctggcgcgtcagctgcagtccggggtattccagccgctggataagagcaaactgcctaactacaaaaacctcgatccggcgctgatggagaaagtggcgcagcacgatccgggtaataaatatgccattccttatctgtggggcaccaccggtatcggctacaacgtcgacaaggtcaaggccgcactgggcgccgatgcgccggtcaacagctgggatctggtgctgaagccggaaaacctggagaagctgaaaagctgcggcgtctccttcctggatgcgccagaagagattttcgccacggtgctcaactacctgggcaaagatcccaatacctctgatgccaaagagtattccggcgcggccactgacctgctgctgaaactgcgtccgaatatccgctacttccattcatcgcagtacatcaacgatctggccaacggtaacatctgcgtcgctattggctggtcgggcgatattctgcaggcgaaaaaccgtgctgatgcggcgaaaaatggcgtgcatctgggctacagcgtaccgaaagagggcgcactggccttcttcgatatgatggcgatcccgaaagatgcgaaaaatctcgatggtgcttacgcctggctgaactacatcatggatccgaaagtgatcgccgatgtctccaacaaaatgaactacgccaacggcaacaaagcgtcgctgccgttgatcaatgccgacgtccgcaacaacccgggtatcttcccgacgcctgaagcgatgtcgaaattgtttgtgctgaaagtccaggatccaaaactggatcgtgtgcgtacgcgcgcatggactaaagtaaaaagtggtaagtaattcgtccttaacggattgacctgtcatgaatcagcaacagaggcgcggtgtcggcctctgttgtgccatttttagcggcaaattttgtcgccatgttccgcctggctccggagagaaaacctttgtgaacgatgccattccccgtcctcaaaataaaaccgcaaaggcgttaacgccactgctggaaattcgcaatctgaccaaatcctttgacgggcaacacgccgtggatgatgtcagcctgactatttataaaggtgagatctttgccctgctgggcgcatcgggctgtggtaaatcaacgctgctgcgcatgctggccggttttgagccgccaaccagcgggcagattgtgctggatggccaggatctgtcccacgttgctccctatcagcgcccgatcaacatgatgttccagtcctacgcgctgtttccccacatgacggtggagcagaatatcgcctttggtctgaaacaggatcggctgccgaaaggggagatcaccagccgggtagcagagatgctggcgctggtgcatatgcaggagtttgctaaacgcaaaccgcaccagctctccggtggtcagcgtcagcgtgtggcgctggcccgcagcctggcgaaacggccaaaactgctgctgctggatgagccgatgggggcactggacaagaagctgcgcgacaggatgcagctggaagtggtcgatattctggagcgtgttggcgccacctgtgtgatggtgacgcacgatcaggaagaggcgatgaccatggcgggccgtatcgcgattatgaatcgcggcaagttcgtgcagattggtgaaccggaggagatctacgagcatcctaccagccgctacagcgcggaatttatcggttcggttaacgtcttcgaaggcttactgcgtgaacgtcaggcggatggcctggtgatcgacagtcccggcctgatgcatccgctgaaagtcgactccgatgtctcggtggtggataacgttccggtccatgtcgcactgcgcccggaaaaagtgatgttgtgcgatgaggtgcctgccgatggctgtaactttgcggtgggtgaagtggtccacatcgcctatctcggcgacctctctatcttccatgtccgtctgcacagcggacagatgatcagcgcacagttgcaaaacgcgcatcgctaccgcaaagggttgccgacctggggtgatgaagtccgcctctgctgggaatgcgacagctgcgtggtgttgacggtttaaggagcggctatgagccagattttccaacgcgctaaagcgcctgcccgactggtcggcacgccgctgcaacgctgggccacgcggataaaaatgcagcatggccgcaagctggtgatcgccttgccttatgtctggctggtgctgttatttctgctgccgtttctgacggtgctgaagatcagcttcgcggacattgcgcgtgcgattcccccctacaccgagctggtgagctgggctgatgaccagttcagcattgtgctcaatttcggcaactacctgacgctgaccgacgatccgctctacgtcgatgcctatctgcaatcgctgaaagtggcggcgatctccacggtgatctgtctgctgattggctacccgctcgcgtgggccgtggcgcacagcaagccatccatgcgcaccattctgctgctgctggtgatcctgccgtcatggacctcatttctggtccgcgtctacgcctggatggggctgcttaacaacaacggtattctgaaccggttcctgctgtggctgggggtgatcgatcatccgctggtgatcctctacaccaatacagcggtctatatcggtatcgtctactgctatctgccgtttatggtgctgccaatctacaccgcgctgacccgcattgattactcgctggtggaagcctcactggacttgggtgcgcgtccgctgaagacctttttcagcgtgattgtcccgctgaccaaagggggcattatcgccggatcgatgctggtgtttatcccggcggtgggggagtacgtgatccctgaactgctgggtggcccggacagcatcatgattggccgtatcctgtggcaggagttctttaacaaccgcgactggccggtggcctctgcgctggcggtcatcattctgctgatcctgattctgccgatcatctggttccacaagcatcaaaaccgtgaaatgggagagaaggcatgaataatttgccaaccattcgctcaccctggcgtaccggtattctggtctgctgcttcctgttcctctatgcgccgatgctgttgctggtggtttactccttcaacagctcaccgctggtgacggtgtgggagcgcttctcgttccactggtacagggtgctcttccaggacagcgcgatgattgacgccgttctgctgagtctgagcattgccggtctctccgccaccatggcggtggtactgggcacgctggcggcggtgattatcgtgcgctttggtcgcttccgcggccacaacggttttgcctttatgctgaccgcgccgctggtgatgcccgacgtcatcaccggtctgtcgctgctgctgctgtttgtagcaatgggtaacgcctttggctggccgagtgaacgcggcatgctgaccatctggctggcccacgtcaccttctgtaccgcctatgtggccgtggtgattaactcgcgtctgcgtgagctggaccgctccatcgaagaggcggcgatggatttaggcgcaacgccgctgaaggtcttttttgtgattaccgtgcccatgattgcaccggctattgtgaccggctggctgctggcgtttaccctgtcactcgacgatctggtgattgccagctttgtgaccgggccgggtgccaccacattgccgatggcgatcttcgccaccgtgcgacgcggcgttaacccggaaatcaatgcgctggcttcattgatcctgtttgtggtcggtttagtgggttttatcgcctggcgggtgatggcacacgaagaaaaacaacgtttaagcgatattcagaaagctaaacgtggctgaaatccgtaacctttgccactatatgaacgggccggtctgaccggcccgtttttcgatcaggtggagtcacggactatgtcagaaatcttcaaaagcagtgccacgctttcaatcgcgccggttccggtgacggttgcgggcattgctattattgcgacccgctgcctgagcgtcctgatgctggcaaacgagctgggttacagtgaactcgccaattttgttcaccgcagcgcccagtcctgggacgcgacactcatctttgtcgccagccagctgatcttcctgttcgaactgcgctgcgcctttaccctgatgcgcggcagtaaccgtggacgctggggctatgtggcgacgcaggtgattgtgctcagctatatgctggtcgcctcgctgggctggatctaccccgagattttcagcattgatggcgacaataacgtccagattatccaccataccctgtcgcagaaaatccccgatctgctggtgctcctgctgctgtttctgcctgccagcagccgcgcttttttcaggaagcgatgatacaatcgcgctccgcccgacccgatcgttaaggctttaccatgcactgcgcgctttatgacgctaaccgttgccgctcctgtcagtggctggaaaaaccctatcccactcagctgaacgacaaacagtcgctgctggaacagttactggctgagcagccggtcgctgcctggttgccgccgatcgcatcaccgcagcaggcatttcgtaataaagccaaaatggtggtgagtggcagcgtcgagcgtccggtgctgggattaatccatcgtgatggtgaagctgtggatctgtgcgattgtccgctctatcccgccagcttccagccggtttttgctgcacttaagccctttatcgcccgtgccggactgacgccctataacgtggcgcgcaaacgcggcgaactcaaattcctgctgataaccgaaagccagcagggcggcgtgatgctgcgctttgtcctgcgttcaaccgcgaaactggaacagctgcgcgccgcattgccgtggctgcaacagcaattgccgcagctggcggtgatctctgccaatattcagccggtgcatatggcgattctggagggggaagaggagattgcgctgacgcccgcgcagtcgctggcagagaacttcaacggagtgccgctgtggatccgcccgcaaagcttcttccagaccaacccgcaggttgccagcgcactctatgccaccgcgcgcgactgggtcagggcgctgccggtcaacagcatgtgggatctcttctgcggcgtgggcggttttggtctgcactgcgcgacagcggagatggaactgacgggcattgagatcagcgccgaggcgataaaatgcgcccagcgttccgctgagatgctgggactggaaaaagtgcagtttgcggcgctggattctacggcgtttgcgaccggacgcgatgcggtgccgcagctggtgctggttaatcctccgcgtcgtgggattggtgaggcgctgtgtgactatctcagccagatggctccggattatctgctctattcaagctgcaatccgcagaccatggcgcaggatattgcccgactgagcgcctatgaggtgacgaaggtgcaactgttcgatatgtttccccacaccgcccattttgaagtgctgacgctgttaacccgccgtcagcacgcgtccgggaaagcatcggcagaggcagcctcagccggtaatcactccgggaaccacttctgattaagctgctgccagctgccgttggctttcagtttcgttcagcgcctgattgaactgatcgcgaagcgccgtattgcctttgcgtacggcaatgccgagaccggtgccaaagtagtccgcatccgtaacatgttcaccgacagtggcgagatccgcattggtcttcagccactgattcaccaccgcgctgtcgccaaacacgccatccagccggccactcttcatatccagaatcgcattctgatagctgtcataggccaccactttcacttccggatgcttatcctgcaggtacttctggtgagtggtgccgttttccacgccaatgcgcttgcccttaagctcagcaaagctgctgaactggcctttacgggcgatcacgatggcggagttagcgtaataaggctgggtaaaatcgacctgcttgctgcgctcagtggtgatatccatgccggaaatcaccgcgtcatagcggcggaacttcagtgacgggatcaggctgtcgaaggcattgttggtaaaggtacactccgctttcatctgctggcacagcgctttggccagatcgatatcgaatcccaccaggttattttcccgatccagggattcaaacggcgggtaggtcgctgaggcggcgaagcgaatcttttccgctgcctgggcggtaagtgccagcgaagccagcgcagcggcaacaatccattttttcattttatgattcctgtgatgtggtcagccagagaaggcgataccctgccataaaatgcatttttatgcaattagtgtgatttttcaggcgaaaagggcgaggggcctcgcccggatatcagttacgtcgttcgaaggccagggcgcgcttttcgatcagccgcatcatcagcgtcagcaaaccgttaacgcagagataaaccagacccgccgcggcatagactgtgatgtcgtaggtgcggccatagagcaactggccgtggcccatgacttccatcagggtgatggtgtaggccagcgaggtgcctttgaacaccagcaccacttcattggagtaggaggagagggcgcgtttaaatgcatatggcagcagaatgcgcagcgtatctttgcggctcatgccgagcgcggcacacgattgccactgtccggaaggaatcgcacgcaccgcaccgtaaaacagctgcgtggtgtaagccgcgctgttcagcgacagcgccagcatcgcgcacagccagggctgcgacagtaaatgccacagccaggggatctgctggatcgagggaaactgtcccggaccgtaatagatcaggaagatctgcaccagcagcggtgtgccggtaaacagtgtaataaagcctttgaccagcgggttgaacaccggcgttttcagcgacagcaccacggtgaagagcagcgccagcagcagggccacgaccagcgaggctgccgtcagcgtcaggctggtatgcaaccctttcaggagttcaggcagataggccagcattagctgttcccccgttcaaagcgggtggtgcgcagttcgatgcggcgtaacaccgcctggctgaacagcgtgatcactaagtagatagcggccgccaccaggaaccaggtaaacggctcctgcgtgcgggtggcaatacttttggtttgcagcatcagatcgttgacgctaatcagcgagaccagcgcggtatctttcagcagcaccagccactgattgcccagaccgggcagggcgtgacgccacatctgcggcataatcagccggagaaagatggccgattttttcatgcccagcgcctgacccgactcccactgacccatcggcaccgctttcagcgcgccgcgcagcgtctgcgaggcgtaggcggcatagagcatcgccagcgcaatcacaccgcacaggaacggactgacgtcgaagttttcaatttcaacctgaatcggtaactgaaacaggccgaaattcagggtgaagccgtcagagagggtgagcagcagctgtgaggcgccaaaatagataaacagcaccaccagaatttccggcaggccgcggatcagcgttaccaggccggtgccaatccacgccagcggtttcaggcgcagtgactcccagccagcgaaaatcatcgccagcaccaggccagcgatgagagcacaaacagcaaggccgacggtcatgccggcggcgcttgcgagggtcatcatttcattcatcagagattactgctggaaccatttgctgtagatggttttgtacgtgccgtctgctttgatcttatccagcgcgccattgaacttggtttgcagatcggtgttaccggtacgtaccgcaatgcccaggccggtaccaaagtaggctttgtccgtgactttctcaccaacggcagccagcgcggcattctgcttcagccactcgttgacgactgcggtgtcaccgaacacagcatcaatacggccatttttcagatccagcaccgcattctgatagctgtcgtaaggaacggtggtgatttcgctgtgtttctcagtcaggtatttctgatgcgtggtgccgttctggacgccaacacgcttgcctttcagcgcttccacgctggcgactttgcctttctgggcaacaaacagcgcggagttgtcgtagtaaggcttggtgaacagaacctgtttttcacgatctggcgtgatatccatgcccgccatcaccgcatcaaagcgacggaatttcaggctcgggatcaggctgtcgaacgcctgattggtgaaggtgcaggtcgcgtcaatctctttacacagcgcattggccagatcgacatcaaagccctgaatcttgttgtccgcatccacaaactcaaaaggaggataagaggcttcggtcgcaaaacgaatcgtctgtgccgccgtagcgctcaggctaaaaccagcaagcagtgcagcaagtaccatttttttcatttttagcatcctgacttagtgcgaaagatagtgagcaaacgcctcggtttgcggctgtgtaaagcggctggcatcgccctgttccacaatgtgaccgttctccatatagacgacgcggctggccgttttacgtgccacctccacttcatgggtcacaatcacctgggtaatgcgggtctgggccagttcgcgaatgatactgacaatctgtgcggtaatttcagggtccagcgcggctgtcggctcatcgaacagcagcacctgcggctccatcatcagcgcgcgggcaattgccacacgctgctgctgaccaccggagagatgcagcggaaagcgatcgctgtagggcgtcaggcgcagccggtcaagcagcttgtcggcgcgggcgcgggcgtcacttttgctgagacccagtacccggcagggcgcttcaatcagattctgcagcacggtaagatgcggccagagattgtactgctgaaacaccataccgacgttctgacgcagttcgcgaatcgcagcatcggagggtttctggctgaagtcgaactgattaccggcaatctgcaactgacctgaacggggttgctccagcaggttaagcacccgcagcagcgaactcttacccgcaccgctgggacccagcagtaccagggtctcgccttgcggacactcaaggttaatgtcgaacagcgcctgatgagcaccgtagaagcagtttattgcgtttagttgaatactcatgcgccagatttgaatagctattagtgtcgcggattttaacgtcaccagaatagttatgcaaataaggtgggttaaaatttgtaaaacagcaggctaaccgcaaaagcttagcacaatatcatgcactgcctgggagcagcgcgctgcagcgggacgggcggcggaaataaaaaaagcgcagcgcccgggggcgactgcgcttctctgaacggttaagcctgaggttattttttcgatttctcaagcatctggctcaggctgccaccctctgcatgcgcagggttggccatgtagcgcacatcatccaccacccagcaactgccctgatggatcatcagcacttcatcctgccactgcttgccgtcgcggctcaggtcgacccgcagcgggatgttgcgtgcatcgcggttcggaatggtggaagcatcagcgacgctggcggcggtcggaccctgtgacaggctggagaagagatcgccattgcgccactgtgcgcctgcattgctgccgctggccgcctgcaatgagtggtacagcgcatcactcaggtaagggcgatattttgccagggtgttgctgtcgggcagaccctgcgtaggctgttcgatacgcaggtcgtaaaactgctgggccacctggtcaggaccgccttcaatgcacggtgcggtacgtgggccattatccttaatcactggctcaacggtggtacaggcgctgagcagcagggccgccgggatcattagcgcaaacgcgttgtttctcatctcgatttccttatggttctctggcaaggtgccctttttagcatagagtatagccgtgctttttagtcgaaagagccttagcccggttttcaacaaggagaatgcgatgaaattttcaacaacccccacgctggaaggtcacagcatcagcgaatattgtggcgtcgtcaccggtgaagcgattctgggtgccaacatcttccgtgactttttcgctggcatccgtgatgtggtcggtggccgctccggtgcttacgagaaagagctgcgcaaagcgcgagagatcgcgtttgaagagctggaggagcaggcaaaagcgctgggcgccaacgccgtggtcggtatcgatattgactacgaaacggtcggcaaagatggcagcatgctgatggtaagcgtcagcggcacggcggtgatcattcgttgaaacggtggctgtggctgatactgtcgctgctgctggcgggctgccagtccgggatagaatcccgtgacggctactgggccgatctgcggcatccggcgcagggcgcgcgaccgcgggtgaagatgatagtgatccactacaccgccgaagatttttcttcgtcgctggcgaccctgaccgatagggaagtcagcgcccactatctgatcccccgccagccgccacagcgcgccgggaaaggcgttatctggcaactggtgccggagcagcagctcgcctggcatgccggtccaagcttctggcgcggagccagccgcatcaatgacacatcgattggtatcgaactggtgaaccagggttatcgccggaccctgacaggtcttgaatggcagccatttaccgctgcgcagatcgccacgctggaggcgctgctgcgcgatattgcacagcgctacggcatcgcaccggaaaatattgtcggtcacagtgatatcgcgccgcagcgtaagcaggatcccggcccactctttccgtggcatcagctggcccagcgcggaatgggtgcctggcccgatgccggacgagtgcagtttcatttagcgggtcaggatccgcacgcggtggtgcccgtggagccactactggaaagtttgcagcgctatggctatccggtgacggcagggatgagcgcgcgtgaacagcagagggtaatcgccgcatttcagatgcatttccggcctgaggattatcgcgggcagcccgatgcagaaaccgccgcgatagccgccgcgctactggataaatatggcgcggcgcaatagcggattattggtgtaaaaacgccttccagtgggcgacgacctgcgccagtgccgcacgatcagcatccagatgggtgaccagacgggtgcgggttcctgcgctgattaacaccccgcgcgccttcatccactcacctaatggtttgacctgggcttccggcaccgccacaaacagcatgttggtctgctgatcgatgacctgaacgcccagctcatgcaactgctgtcccagccaggcggcattgtcatgatcctcctgcagccgcgccacattgtgttctaacgcatagagacccgccgctgccagaataccggcctggcgcatgccgccgccggtcattttacgccagcgacgtgcgcgctcaatcagcgccgtgtcgccacacagcagagaaccgacaggcgtgcccagacctttagagagacagatggtcagggtgtcgcagtagcgggcaatcgccgccagcgtggtctgctgcgcgactaccgcattgaaaatgcgtgcgccatcaatgtgcagcgccagctggtgctcgcgggtaaaggtccacgcctgttccagatacgccagcggcaggactttaccgtgatgcgtgttctccagactcagcaggcgggtgcgggcaaagtgaatatcgtccggcttgatggcggccgctactacgtcgagcggcagcgtaccatcgtcggcggccagaatcggctgtggctgaatactgcccagcaccgccgcgccgcccgcctcatatttgtagttgtgcgcctgctgaccgacgatatattcatcgccgcgttcgcaatggctgagtagcgccaccagattcgcctgggtgccggtcgggaaaaacagcgccgctgctttgccgctcagccgtgcggcttccgcctccagcgcatttacggtggggtcgtcacggtagacgtcatcaccggtttcggcagacatcatcgcgcttaacatggcggcgctgggccgggttacggtatcactgcgtaaatcgatcaccctatgctcctgaacgtggcggaagaaaaaaaaggcgggcatcgcgcccgcctggatggagtctctgttttaccgcagccagttggttttcgccagttctaccacctcatcaccgcgaccattcatgatggcgcgcagcatgtagagactgaagcctttagcctgctccattttgatctccggcggcatcgccagttcctctttggcggtaatgacatccaccagcaccgggccatcgtgggcaaacgcctgctccagcgcgccattgagatcagatgccttttccacccggataccccggataccgcaggcctcggcgatagcggcaaagtcaggattctccagctcggtgccatcggtgagatagccgcccgctttcatctccatcgccacaaagcccagcacgctgttgttgaaaatcaccagtttgaccggcattttcagttgcgccagcgagataaaatcccccatcagcatgctgaagccgccgtcgccacacagtgccaccacctgacgattgcgatcaatcgactgcgcgcccagcgcctgtggcatcgcgttcgccattgagccgtggttaaacgaacccagcaggcgacgtttgccgttcatcttcagatagcgcgccgcccagacggtcggtgtcccgacatcgcaggtaaagatggcgtcatcactggcgtagtggctgatctgctgtgccagatattgcggatggatcggctgcttgtcgttgggctgcgccagttcgtccagacttttacgtgcctcgccatagtgcttaaccgcgctgtcgaggtggctgcgatcgcttttgtgcgtcagctgcggcagcagcgcctgcagtgtgcttttcacatcgccgacataggcctgatcgacgtgacaatgtgacccaaggctgcccggattgatatcaatctggatgattttagccttttccggatagaaggcgcgataggggaactgcgtgcccagcaacaccagcgtcccggcattcatcatggcgtggaaaccggatgagaaaccgatcagtccggtcatgccgacatcataagggttgtcatattcgatgtgttctttgccgcgcagcgcatggacgataggggctttcagcgcttctgccagcgctaccacctcctgatgcgctccggcgcagccactgccgcacaacagcgtaatatcgctggcttcgttcagcgtctgcgccagctgcgccagttcggcgggctgtggcaggacctgcggcaactgtggcggataccattccgcgctggcgctctctggcgccagtttaagcgcgacatccccaggcagcaccaccaccgagacgccacgattcagaatcgctttacgcatcgcgatgcccagcacctgcgggagctgctcagggttcgaaaccagttcgcagtagtggctgcattcgcggaacagctcctgcggatgggtttcctgaaaatagccgctgccgatttcgctggagggaatatgtgccgcaatcgccagaacaggaacgcggttacgatggcaatcgaatagaccgttgatcagatgtaagttgcctggcccacaggagccggcgcagaccgccagttcaccgctgatgtgcgcttccgcgcccgctgcgaatgcggcgacttcttcatggcgcgtcggcatccattcaatggtgcccatgcgattaagactgtcgctcaggccgttaagggaatccccggtgacgccccagatgcgttttacgcccgcgctttccagcgttttggcgaccagcgccgcgacggtttgtttcatgctcttctcctttgtcggcccgccctgaagagtgacgtgaccagaaccgaaaaaagaagcgtagacgacacggcagaaaagcaggcgtgaaaaaatgcgctggcagagctcagcgcatatcagacaggattcaggcggagaagagggcgataagaatcggggccagcaggctcatcacaaagccgtgcacaatggcggccgggacgatctcattgccgcccgcccgctgcagcaccggcagggtaaagtccattgaggtggcgccacacaggccgagtgcgctggagcgatgacggccaatcaacgccggaatgagcatgattgccaccagttcacgtatcaggtcgttgaagaaggcggcgctgccgatgaccggaccaaaagcttcggtcatcagaatgccggagagagagtaccagccaaaaccactggctaacgccagaccggttttcagcggcacgcccagcagcaacgccgcaatcatgccgccgataagcgcgctgaccagcaccacgctggcaaccagcaggccacgacggttcaggataatctgacgcagcgtcatgccgctgccgcgcagctgaatgcccaccagaaacagcaggaagatcagcgcatattcgctggccgtcgaggcgtggtgcagcagtggccactgggtcaggccaagcagaaaaccgatgacaaccacgccgcacagcttcagagagtccagcgccatatgcagccgcgagggcagtttctcctgccggtgtgcatgctgccagggggcatatttttccagcccgcgcagcgccagcaggttgcacagcagaatgcagaaggccgctaccagcgcggtgtgaaataccgccagcagattgctgctcaggttgtcgagaaaggccaggctgatgcccataaagaacagaatgacgtaaaccatccagcccagcagctgattgacccggcgcagggttgaagtttgacggaacggtagcagccagccggcgatcagcggcagcagaataatcaggagtccggagtacatagcgataagggccatccatggtggaagaggccacacgctagcgaaaaagcgtaacggagtaaaccctgagaaagcggcttgaccggctcgctggcggcaaccatgctgtttataaactgaggatggacgcctatgattctggaacatatcgacattcgcggtttccgcggcatcaataagctctcactgcctttaacccagaccaatctgctgattggtgagaacgcctggggcaaatccagtctgctggatgccctgagcctgttactttcggcccatgaaccggcctatgtttttaccgaggctgatttccatttcaccccaggcgatgtgactgatgcgatgcgccgtctgtcggtggtgttccactttcgcgatgacggcaacgacccggatgcggtgctctcgaccttctggcagcgtgatgctcagggccagcgtcagctctgttacagcgtcagcgccacctggcgtgacagcggtatcgaaacccgccgccgttttgttgacctgaactatcagctgttgactgagcagaactgcgcggcggccatcgatcttttgctgaaacggtatccggttctgcgattgcgcgatgcgcgtttcagtaagcggacgcggagtagtgcgccgctccccaccgcacatcctgagctactggcgggtatggagacgctggcgcgcgatctggagcaccatccgcaacagctcagcgatgaggtgctgcggcaggggctgaagacgatgcagcaactgatgcagcactacttcctggtgcagccgcctgatgcgggcaacgaggtcaggctacgggatccgcagacgcgcgaggggggacagggatggcgggcgctggatcacctgaatcaactgattgccggaaccgactcccgcagccgtcagctgatactgctgcagatgtttaccctgctgattgaggcacgaggagacgtcccgctggccgctggtgcacgcccgctgctgctgattgaagatccggaaacccggctgcatccgattatgctgtcggtagcatggaatctgctgaggctgctgccgctgcaaaaaatcgccaccactaattcgccggagctgctgtcgcaggtgccggtggaaaacgtctgtcgtctggtgcgtggaccctcgcgcgtagcggcctggcgcatcggtccggagggactgagtgccgaagagagccggcgcatcggcttccatattcgggtcaaccggcctgctgcgctgttcgcccgttgctggctgctggtggagggagaaaccgaagtctggatcatgaatgagctggcgcagcagtgcggttacaacttcgccgctgaaggcgtgaaggtgattgagtttgcgcagtcggggttaaaaccgctactgaagtttgcccggcgcatgggtatcgcctggcatgtcctgactgacggtgatcaggcggggaataaatatgccagtacggcacgcactcagttacagccgggtgaaccggagccgcgttttctgacgcagttaccggcgctggatatggaaaattttctctatcagcacggctttcaggatgtctatcatcagatggcgcacctgccgttaaacgttccgatgagttccaggcgtattattactaaagcgattcaccagagctccaagccggaactggcgatcgcagtggctacgtcggcggcggaaacgcgggccagaggccatcccgccattgatgcggcagatgtttgcccgggtgattagactggcgcagggacaggcagattaggtgacatcgaacaggaaaatgccagcggcactggctggcatttttgggtctttgttcagaaaggcgatatgtgtcaggccacagcctgcacctcgaccggcacgatcaggctggcgtgattgcctttcgggccttcgtggacatcgaactgaacctgctggcctgccttaagcgtgcggtagccttccatctgaatggtggagtagtgcgcaaaaatatcttcgccaccgccaatcggacagataaagccaaagcctttggaattgttgaaccatttaactgtgcccgtctccatgcttttacttccctcgcaagacattttataagtaggtgaggtcatcgaagctgtgagtcggatttgattaaaactcaatcagcctgtgcagctagaatgtagagaaagcgcggctgacgtcaagcaaaccaccgggccaggtggggaaaaaatcatcaaaatttgaggcagttaacgctattgcaaattttgtgatgcaggtcgcgcaggggaatttctgaataaattttcagcagcggcatgcggcttgacaggcatgttaaactctcaatatgtagctacttaaaggctaaaagcaaaatctcaacggaacactatggcaaacgcaaacgactggcttaactttgaacatctggccgacgataaagtacgtgaagggttaaagccgccttctatgtataaagtcattctgaataatgacgattatacacctatggaatttgttattgacgttgtacaaaagttcttttcttatgatgttgaacgtgcaacgcagctgatgttgaaagttcactatcacggcaaggcgatctgtggtgtatttactgcagaagtcgccgaaacaaaagcggcccaggtgaacaactatgcacgggaaaatcatcatccgttgctgtgtacgctggaaaaggcctgaacccgtctccatataggaaacaggtaagggcgataattgggggaggtgcctaatgctcaatcaagaactggaactcagtttaaatatggctttcgccagagcgcgtgagcaccgtcatgagtttatgaccgtcgagcatctgttactggcgttgctcagtaacccgtcggccagagaggcactggaagcctgtacggtggacattgtggctctgcggcaggaaactcgaagccttcatcgaacaaactacgcccgtgctgcctgccagcgaagaggagcgtgatacacaacccacgcttagcttccagcgcgtcctgcagcgtgcggttttccatgtccagtcatccggtcgcagcgaagtctccggtgcgaatgtgctggtcgccattttcagcgagcaggagtcgcaagcggcttatctgctacgcaaacatgaagtgagccgccttgatgtggtgaacttcatctctcacggtacgcgtaaagatgagtccggccaggcgccaggcgcagaaaatccggttaacgaagagcaagcaggcggggaggagcgtatggaaaacttcaccaccaatcttaatcagcttgctcgcgtcggtggtattgatccactgattggtcgcgataaagagctggaacgtaccgttcaggtgctatgtcgtcgccgtaaaaataacccgctgctggtgggtgagtcgggtgtgggtaaaaccgccattgctgaaggtctcgcctggcgcatagagcagggcgatgtaccggaagtgatgaaagactgcacgatctactcgctggatatcggttcgttattagccggcaccaagtaccgtggtgactttgaaaaacgtttcaaagcgctgctgaaacagctggagcaggacgaacacagcattctgtttatcgatgagatccataccatcatcggtgcgggtgctgcatccggcgggcaggtcgatgctgcgaacctgatcaaacctcttctttcctctggcaagattcgggtgatgggttccaccacctatcaggaattcagcaacatctttgaaaaagatcgtgccctggcgcgtcgcttccagaagatcgatatcacggagccttcaccagaagagaccgtgcagatcctgaatggcctgaagaccaagtacgaagcgcatcacgatgtgcgctataccgcgaaagcggtgcgcgcagccgtggaaactggcggtgaaatatatcaacgaccgtcatctgcctgacaaggcgattgatgtgattgatgaagcgggtgcgcgagcgcgcctgatgccagccagtaagcgcaagaaaaccatcaacgtctctgacattgaaacggtggtggcccgtattgcccgtattcctgagcaaagcgtgtcagcaagcgaccgcgatacgctgaaaaatctgggcgatcgtctgaagatgctggtgtttggtcaggacaacgccattgaggcgctgacggaagcgatcaaaatgagccgtgcaggtctgggtcaggatcgtaagcccgtcggttccttcctgtttgccgggcctaccggtgtcggtaaaacggaagtcaccgtgcagctggcgaaagcgctgggcattgagttgctgcgctttgatatgtccgagtatatggagcgtcacaccgtcagccgtttgattggtgcgcctccgggttacgtcggctttgatcagggcggcctgctgacggatgcagtgattaagcatcctcatgcggtggtgttgctggatgagattgagaaagcacacccggatgtcttcaacctgctgctgcaggtgatggataacggtatgctgaccgacaacaacggtcgcaaagcggacttccgcaacgtggtgctggtcatgaccactaacgccggggtccgcgagactgaacgtaagtcgattggcctgattcatcaggacaacagcaccgatgccatggaagagatcaaaaagatgttttctccagagtttcgtaaccgtctcgacaacattatctggttcagtcacctgtcaccagaggtgatccatcaggtggtcgacaagttcattgtcgagttgcaggcgcagctggatgccaaaggcgtgtcgctggaagtcagcgatgaagcacgcgactggcttgctgagaaaggctatgacaaagcgatgggcgctcgtccgatggcgcgcaccgtgcaggacagcctgaagaaaccgttagccaatgaactgctgtttggttcgctggtggatggcggctcggtgtcagtggcgctggatcgtgagaaaggtgaactgacctatcacttcctgagtgctgaaaaacgcaaaaccgaaggcacggtgcattaatcacctgctgcagatatgaaaaaggccggattaaatccggcctttttttttcgctgcaaattgcagagcgatgagattactgcaaattagcgactacggaagacaatgcggcctttgctcaggtcgtacggggtcagctcaacggtcactttgtcacccgtcaggatgcggatgtagtttttgcgcattttaccggagatatgagcagtaaccacgtgtccgttctcaagtttctacgcggaacatggtgttaggtaacgtatccagtacggtaccttgcatttcaatattgtcttctttggccatcgaatcctctgggtgtactacctttcagttgaaccggcaagataatgcccaattcaacgatttatgtaaagaaccgtcggcgattttgccaacgctttgccggggtgcacgtcagtcgcgcgcatccggtaaaattagggtgtttatgtgacgtctgcgggggattagcgggctaagaatctgtatcaaccggttacacgcgcacgattgaaaacagttccgagagtgcgttgagattcccagcctggcaattccggctcgttattgcgaagcgcggacgacataccaaactcgaccattataccacttaatacgcctttatgtgtgcaaaacatctctgtgcgactaaaaaagggtttgtgtctgccagcagccatcgctgacaggctggcacgcaaggctttgtacatattgcagatagtctgcgcgcggtatctcctgcgcccccaaagaggccgtatgagggttaagtacctgacaatccaccagacggccctgatgtctgaggaaatgctgacaaaatacccaaagtgcggtttttgacgcattctgctgacggctgaacattgattcgccgcagaagatttgccccatcgccagcccatacatgccacctgccagctgatgttcgtcccatacttcaatggagtgggcgtggcccagttcatacaatcgcaaccaggcgcgcttcatttcaaaggtgatccaggtgccttcctcacgaccggtggcacagccctcgatcacctcggcaaatgactcattcatcgtcacccgatagggcgaacggctgtggaaacgcttcatgctccggctgagatgaaactgctcaggcaacagcactgcacggggatcgggcgaccaccagagaatcgggtcgccagaagaaaaccacggaaagatgccgcgctgataagcgttaagtaaccgggcaggggagagatcaccccccatggccagcaggccgtttggctcgcgcagcgccatctccggtgggggaaattgcaaagattcccgtgacagttgtaccagtctcatcgcgttatgttacccatcagcatttcgctaagactatagcgcaatccgctgccggaaacgccagtaccgacccgcttttgagattaattcggcatgacttccctgttccacaatcacgccattatccatcacgcagatgcgatccatctgctccaggccgctgagccggtgggtgaccattattacggtcttgccagcggtcagccgctgcagcagggtgaggatatgctgctcggttgtggcatccagtccttcggtgggttcatccagcagccagagatcgccgttatgcagtaacgcacgcgccagcgccagccgacgcagtttcgccgcctgacagcgggcgaccgccttctcccatccaggcgtttaatccttccgggctctcaagcaggcgctgcaggccgacgtcattcagcacgcggcgtaactgctcatcagtagcatcgggacaggccagcagtaagttatcacgcaggctctgactgaagagatgaacccgctgagtcaccacgctgatgcgctgacgcagcgctggctctgaccatgcggtgatcggcaggtcattcaggctgatgacaccgtgctggctatcccagccacgggtcaacagcgccagcagagtggatttgccgcagccggtcggccccagcagtgcaatgtgttcaccggctgccaccttaagggtaaagcggttcagcaccttatccgggcggtcgggatagctgaagtcgagctgatcgatagcaaccgcgagtcgtcctggccgggcgtctgaatctgccggaaaggtgatagcgggtgactgatcgataatgtcattgactcgctgagcggcatttatcacctgcgacatgggcagaaaggcccctgcaaccggtgccagcgcctcgaaagcagccagcgcgcaaaacaccaccagggcaatcagcgagccgggcaactgctgctggctgattgtcgccgcactgagccagagcaacagtgtgacggttacgccgctgatcagcagcagcaggctctgtgccgcagcctgcaagcgctgttgctggctctgagcctgctgccagcgctgttcatcttcatcaagttgctgacgccagccccgcgaggcaccgtacagggtgagttcagcctgagccgccagccactgcatcagctgtaagcgccagcgggcgcgcccacgggcaatcgcgccgcttgcgggcgatcccagacggtaaaacagcgctggtatcaccaccagggtactcagcatgatgccgcccagcgtcagtgccagctgaagatcgatgaagctcattccgagggtaaccacgacaatcaccaccagtgcgccgatcagcggcgagatgacgcgcagatagagatgatccagcgtatcgacatcggccacgaagcggttgagcagatccgcctgccggaaccgcgaaagctggcctggcgaaagggccatcaggcggctgaaggtgtggacacgcagatgctgaagaaccctgaatgttgcatcgtggctgaccagacgttcagcatagcgtgcggcagtgcgaatgatggcggcgccacgcacgcctgccgcaggcagcatatagttgaaggtatagagaccggctacgcctgccactgacgaggcggccagaaaccagcctgaaagcgtcagcagaccgatactggccagcagggtaacaatcgccagcacgatgcccagcgccaggcgataagggtggcgcagccagagacgaagaaaaggacgcaaggcggacatcagcgaatctcctgttgacgatgcttcagcatctcactgaaagcacccggctgttgcgacagctgctgccagttaccctgttgcaccagcttaccggcttccattacccagagggtctgccagtgacttagcgtatcaatctgatgggtaatcatcagcgtggtctggcgggctgccgcctggttcagtgccagcatcacatgacgttcactgagcgcatccaggctggctgcgggttcatcgagcagcaaaaaatgcgaggatttatagagtgcgcgcgcgaccgcgacccgctgcgcctgacccaccgacagctgattaccgccatcgccgggctgggtgtcaatgcccttgggcagacgaggcaggaactcattaatgccgcacgactccagcagcgccgcaaaacgctcgtcatcccaggccgcattcatcacgatgttgtcacgaaaggtggcggccggtaactgaggattctgtcctacccaactgagctgctgatgccagtcactccgtcgtatatcgcgaagttcaacgccattcgctttcagcgaaccctgataaggcagaaaaccgagcagggcgttcatcagggccgttttaccggccccgctttgaccgaccagtgcaatctgttcgccagggacgacagtaaaagagagcgggccgcacaacacctgaccatcaggcgcacagacacgcagatcttcggcagtaagtgcgattgagcgatcggcggtgaagggcaactggccttcctgcggcgcggtggcaggcgtcgcctgcataaaggcttcaagggcatcggcaccgcctacagcctgggctttggcgtgatagaaagcgccgagatcgcgcagcggctggaaaaactccggggcgaggatcagcaccagaaagccggcaaacagcgtcacgccctggccgtaatcaccaaaatgcaattcgcccagataggagaagccaaagtagacggccaccacggcaatcgccagcgaggcaaaaaactccagcacggcagaggagagaaaggctaagcgcaatacttccatggtgcgctggcgaaaatcggtggtggcggcggcaaccgcctcctgctccgctgcgccacggtgaaacagccgcagcgtctctctgccgcgcaggcggtcgagaaagttaccgctcaggcgggccagcaccaggaagttccggcggttggcctcggccgcacccatcccgaccagcgccataaacagcggaatcagtggcgcggtggcaaacaggatcagacccgccgtccagttgagcggaaaaatagtcagcagaatgcagcaggggatcagcaccgccagggtcatctgcggcagatagcgcgcgtaatactcctgcatctcttcgatctgctccagcagcagcgtcgcccaactgccggctggctttccctgaatccacgccggccccagatcagataaccggtctaatacctgctgacgtaaagcctgacggatagcctgtccggcacgataaccggtcagttcacgggcatagttaatcagggcgcggagcacaaagcagagcagtagcagcagaatgctgacagtcaaggattcacgcggctgctggtcaacaatcagagcctgcagcagcgaggccagtaaacccgcctgagcaatgatcagaagtgcacttgccatgcccagcagggtgttgagtcgcaaccagcgaccggcgaaatgacgttgctgacgaagccagcgggtaagatgctgctgccgcgatttgtccatgcgagaccatgatgaatgtcgatgacgggtgaaaatggaaagacatttccatctcttcaggcgcaagaatctagcatgagagcaataaaaaaggcgacggaaaaaccgtcgcctggaacatttgagatcagagggttaacaacttaccgatcgtttttaaccagtccgtcaagaaagcgctcagcgtctaacgcggccatacagccggtgcccgcagaggtgatcgcctgacgatagatatggtccatcacatcgcctgccgcaaagacgccagggatgctggtctgagtggcgttgccgtgcagacctgactgaactttgatgtaaccgttctccagcgccagctgaccctcaaaaatggccgtattcgggctgtgtccgatagcaacaaaaagacccgccacctccagcgcttctgtctcatcactgttctgggtagaacgcagtgtcagaccagtgacacccatctgatcgcccaccacttcttccagggtgcgatgggtgtgcagcacgatattgccattgcgcactttttccatcaggcggtcgatcaggatcttctctgcgcggaagctatcacgacggtgaataaggtgcacttcagccgcaatattcgccaggtagagcgcctcttccacagccgtgttgccaccgccaatcaccgcgactttctggttgcgatagaagaagccgtcacaggttgcacaggcagagacgcctttgcctttaaaggcctcttcggaaggcagaccgaggtagcgcgctgacgcaccggtggcgatgatcagggcatctgccgtgtattcgccactgtcacccgtgaggcggaacggacggttctgcaaatcgacggtgtgaatgtgatcgaaaatgatctcagtattaaatttttcggcatgctcatgcatccgctccatcagcgatggacctgtcagatcgtgcgggtcgcccggccagttctccacctcggtggtagtggtcagctgtccgcctttttccagacccgtgatcagtaccgggttcaggttggcgcgtgcagcataaacggctgcggtataacccgctgggccggagcccagaatgagtaacttactgtgtttggccgtactcatgcgttcctcagtttcattcggctgacatagcctgcgattgtagggaatatccggcgacaatgacaaggcttaggcaattttgttaacgatagctgcaaacggcgtagacgatgagcgacggttttgcctggccaatgcgccaaaagggggcaaaactcgggtcagaggggtgcaatagtggaaaaatagtcatttaaaaacagatacccagcggactgtctggcatcttgtcctgaatttggtgattttactttgacaatcgcctgcgcttttgcgaaaacattatcagaagcgaataacatttatcggaacaaaacaggttttcatcgcccgttttgcacgtaacgccgaataaaagcagcctgatatggataatgacgcatgatgtggacagacaacatgcgtcatatcgataggtgtcagaacacaggctctgttagctcacttcagaaatgccccgaacaatgagcgttttcagggcgtggcaggtaaagggaaggaattaagagagacaataataatggtagacaataagaaacgccccgggaaagacctcgacagaattgacaggaacattctgaatgaacttcagaaagatggtcgcatttcaaacgtagagctttccaaacgcgtaggcttatcgcctacgccatgtcttgagcgcgtgcgtcgtctcgaaacgtcagggatttattcttggctacaccgcgcagctgaacccgcactatctggatgcgtcgctgctggtgttcgttgagattactctgaatcgtggtgcaccggatgtgtttgagcaatttaacgccgctgtgcaaaaacttgaggaaactcaagagtgtcacctcgtttccggcgatttcgactacctgctgaaaacgcgcgtacctgatatgtcagcctaccgtaagctgctgggtgaaaccctgttgcgcctgccgggcgtaaacgacacgcgtacatatgtggtgatggaagaggttaaacagagcaatcgactggtgatcaaaactcgctgatgcggggcaggtgcaaaacctgtgagatttcggtacactcctgtgcattcatacaggatcagcgtcgggctcgcccggcgctgttgcttcttactttacaggcacctggagagtcctcttgagccaggaatatacagaagataaagacgtttcgttacaatcgatgagcagtggacgtcgtctgctggaagcgatgctcattctggtggcgctgtttgccatctacctgatggtttctctggtcagttttaacccttccgacccgagctggtcgcaaacggcctggcatgaacctatccacaatatcggcggcagcgtcggtgcctggctggctgacaccttactcttcatttttggtgtgatggcgtatgccattccgcccgtcatcctgggtctgtgctggattgctttccgtcagcgcgacagccaggactactttgactactttgccgtcgggctgcgcttaattggcgtcctcgcgctggtggtgacgacctgtggtatggcggcgctgaacgccgatgatatctggtactttgcctcgggcggcgtgatcggcagcctggtcagtaatgctattgcaccctggttcagtccggctggcggcacgctgatgctgctctgcgtctgggcggcgggcattaccctttacactggctggtcatggctcaccattgcagaaagaattggtggcgtagtcatgggcgtactgacgtttgccagcaaccgctcacgtcacgatgaaccctggcaggaagaggatgacgagcgggacgcgcgtgaatacgcggatgtgcctgagcttcatgccgccgatcaggatgatgatgtgctgctttctgccccacgtgcagctgttgagcctgcggcgtcacaacaggatccgctgctggctaaagctgcagcagccaccagtgcggcagtcgcggccaccgctgaagccgctgaggtgaccctcgccccggcagccacggtgacgcctgcacctgtcgccgcacctgctgctgctgcggtttcagcttcggcgcctgccgcgtcagcgacatccatccctgcatcgccgtctgcacaacctgcgcctgcgtacgcacagagcgcgccagctccgcagagtgtggcgaattccccggcgcagagtgcttctgcacccgcagactcaccaccgctttatcattttgaaatgccagacgacgctccggctacgccgtcgttcagtgcttacgacgatgatgaacctaaaatgggtaactggcgggatacgtcagccatccctgcggcatcggcggcagcggcatccgctgcaacggcagcccaggcaacaacgcgtactgcgcctgtttttgatttagcccctgaaaccaatctcaatccgcaggttaaacaaggtatcggcccggcactgccgcgtcctaacccggtaaaactgccaacccgtcgtgagctggcctcttatggcattaagctgccttctcagcgcatggcagaagagaaagcgaaaacggaagagaccgaaccggttagtgctggctccgtttcctctgctccggatgctgaagaggcgctgcagcaggctgaattgcgacaggctttccagtctgaacagcagcagcgttacggcaccagctggcagcaggacgaggaagatgaacaggatgcacagcagcaggatgcactggcgcgtcagttcgccgagcagcaacagcagcgctatgagccagaagtgaaaaaagagccggtattcaatattgataccgcctcagcgtttgatttttcaccgatgaaagatctggtggatgacggtccttctgaaccgctgtttaccattgcggcgacgccagaacctgaagctccagcggtttcacacgaaccctggcagcaggtgagtgaggtttcaagacctcaggctccggctcatgttcctgcaccagccagctttgccccggcagaacctgcctatagcgcgccggcagcaccgtctgaacctgactatgctgcacctgcggcaacctctgcacccgcttatggtgcccctgcggctcctcaggctccggcttacgctgcgcctgcctatggcacgccagcggcagcgccggttcagccggtggaagaggcgaaaccttcactgcatgacagcctgattcatccgttcctgatgcgccatgagcagccgctggagaaaccttccacgccactgccttcgctggatctgctgaccgcaccgcctgaagaggaagagccggttgatatgttctcgctggagcagactgcccgtctggtggagtcgcgcttaggcgattatcgcgtcaaagcggaggtggtcggtatatcgcctggcccggttattacccgtttcgaacttgacctggcgccgggcgttaaagcggcgcgtatctccaatctgtcccgcgatctggcgcgtttcgctgtcgacggtagcggttcgtgtggtggaagtgatcccaggcaaaccctacgtaggtctggaactgccaaacaagcatcgtcagaccgtctatctgcgtgaagtgctggattgccctaaattccgcgacaacccttcaccgctggccgtcgtgctgggcaaagacattgccggtcagccggtggtggccgatctggcgaaaatgccacacttactggtcgccggtaccaccggttccggtaagtctgtgggcgtgaacgccatgattatcagcatgctgtataaggcgacgccggaagaagttcgcttcatcatgatcgacccgaaaatgcttgagctgtcggtctatgaaggtattccgcatctgctgaccgaagtggtcacagacatgaaggatgctgccaatgcgctgcgctggagcgtcggtgaaatggagcgtcgctacaagctgatgtcggcgctgggcgtgcgtaatctggcgggctacaacgaaaaagtggaacaggccgaagcgatgggtcgtccgattcccgatccgttctggaagccgggcgacagcatggatatgacgccgccggttctggagaagctgccttacattgttgtgatggtcgatgagtttgctgacctgatcatggcagtcggtaaaaaggtggaagagctgattgcccgcctggcacagaaagcccgtgctgccggcatccatctggtactggcgacacagcgtccatccgtggatgtcattaccggtctgatcaaagcgaacattccgacgcgtatcgcctttaccgtttccagcaaaattgattcacgtaccattctcgatcagggcggcgcggagtcattgctgggtatgggtgacatgctctacatgccgccgaactcctcgctgccgattcgtgttcacggtgcgtttgttcgtgaccaggaagtgcatgcagtggttcaggactggaaagcgcgtggtcgtccgcaatatatcgacagcattacggcgggcgaagagagcgaaaatgccggtggcatcgacagtgatgaagagctcgatccgctgttcgatcaggcggtcggttttgtggtcgataagcgccgtgcgtcgatttcaggcgttcagcgtcagttccgcattggctataaccgcgcggcacgtatcattgaacagatggaagcgcagggcatcgtttctgcaccaggacacaatggtaaccgtgaagtgctgtcgccaccgccacacgatatgtagtggctaaatgttttgaaacacaacgcaatgagccagttccgactggctcattgtttttatgcggttaaaccccatatctgaatcagctttcggctttttcctctgttctgatggcggaacggcggccaggcttaatgcagttatcgatgggaacgtttaaataaggaattgaagcagatgaaattacgcgtaatcgctctgggcctgttggccaccttttcttcagccagcgttctggctgatgcttccagtgatctgcaacagcgcctgaacaaggtcagcagcttccacgccagcttcacccaaaaagtgaccgacagcagcggcgcgaatgtgcaggacggcgaaggcgaattgtgggtaaaacgtcccagcctgtttaactggcacatgaccgcgccggacgaaagcatcatcatctccgacggtaaatcgctgtggttctacaacccgtttgttgagcaggcgacagtcagcctgttgcagaatgcgaccagcaacacgccctttatgctgattgcccgcaaccagtcaaatgactggaagcagtacaatatcaaacagcagggtgacaattttgaactgacacctaagaacagcgacggcaatctgaaacagttcaccatccaggtgacgtccagcgggaccatcaaccgcttcagtgctatcgaacaggatggccagcgcagcgattaccagctgaaaagccagcagaatggcgctatcagcccggataaattcacgttcacaccgccaaaaggcgtgacggtggacgaccaacgtcagtgaggtcacggtgagtaacctgtccctggatttttccaccgaaaatttcaaacctctggccgcgcgtatgcggccagaaacattgaaacagtacattggtcagcaacatctgctgggcgcaggcaaacctctgccgcgcgcgattgaagcagggcacctgcattcaatgatcctgtggggacctcccgggaccggcaagaccacgctggctgagatcattgcccattacggtaacgccgatgtggaacgtatttcggccgtcacctccggcgtaaaagagatccgtgaggcgattgagcgggcccgtcagaataaacatgccgggcggcgcacgatcctgtttgtggacgaggtccatcggttcaacaagagccagcaggatgcctttctgccccatatcgaagatggcaccattacctttattggtgcgaccaccgaaaacccctcttttgaacttaactctgcgttgttgtcacgcgcccgcgtttacctgctgaaatcactgactctggaagatattgagcaggtgctggatcaggcgatgcaggataaagcgcgaggctatggggacagtgacatcgtgctgccggacaacacacgcaggatgatcgctgaactggttagtggtgatgcacgtcgggcgctgaatacgctggagatgatggctgatatggccgaaatcaccgcatcaggtcagcgagaaaactgacgccgcagctgcttaacgaagtctctggtgagcgatccgcgcggtttgataataaaggcgatcgtttttacgatctgatttccgcactgcacaaatcggtgcgcggctccgcaccggatgcggcgctctactggtatgcgcgcattatcactgcgggcggcgatccgctctatgtggctcgtcggttgctggctattgcctccgaagatgtgggcaatgccgatccgcgcggtatgcaggtggcaattgcggcctgggattgcttcacgcgcgtcggtccggcagaaggggagcgcgcgattgcccaggcgattgtttatctggcttgcgcgcctaaaagtaatgcggtctacaacgcgtttaaagccgcaatgcgtgatgcacgcgaccatcccgattacgatgtgccggaacatctgcgcaatgccccgactaagctgatgaaagagatgggcctgggtaaagagtaccgttatgcccatgatgaaaccaacgcctatgccgcgggtgaagtctattttccgcaggaactggccagcgcgcgctattacaccccaacccagcgcgggcttgagggcaagattggtgaaaagctaagctggctggctgagcaggatcaaaatagcccgacaaaacgctaccgctgaaacagacgttacggtaatgtgggcaatgttttcaacgcattccgctggaatgcgtcccttctttcaaccaactttttatacacaggataagcatgctcgatcccaatctgctgcgtaacgagccagacgcagtcgcagaaaaactggcacgccggggatacaaactggatgtggaaacgctgcgttcgcttgaagagcgtcgcaaagtgctgcaggtggaaacagaaaatctgcaggcagagcgtaactcccgatccaaatccatcggtcaggccaaagcacgtggggaagacatcgagccgctgcgtcaggaagtgaacgcgctgggcgaacgcctggatgccgcaaaagcagaactggatgaactgcagaatcaaatccgtgacttctcactggcactgccgaacattccggccgatgaagtgccgctgggcaaagatgacagcgaaaatcaggaagtgagccgctggggtaccccgcgcgagttcagcttcccggttaaagatcacgttgagctgggtgaagcggctaaaggcctggattttgcgtctgccgtgaaactgaccggttcacgctttgtggtcatgcaggggcagattgcccgcctgcaccgtgcactgagtcagtttatgattgacctgcacaccgagcagcatggctaccttgaaacctacgtgccttatctggttaaccacgaaacgctttacggtaccggacagctgcctaagtttggcgaagacctgttccacacccgtccgctggaagaggagtcagacagcagcaactatgcgttaattcctactgcggaagtgccgctgactaacctggtgcgtgatgagatcctcgaagaggatagcctaccggttaaactgactgcgcatacgccgtgcttccgttctgaagcgggttcttacggtcgtgacacgcgtggcctgatccgtatgcaccagttcgacaaagttgagatggtgcagatcgtcacgccggagcagtcaatggatgccctggaagagctgaccggtcacgctgagaaagtgctgcagctgctgaacctgccatatcgtaaggttttactctgcaccggcgatatgggctttggatcgactaaaacttacgatctggaagtctggctaccggcgcagaatacctatcgtgaaatttcatcctgttccaacatgggtgatttccaggcgcgtcgtatgcaggcgcgttgccgcaacaaacaggataagaaaccgcgtctggttcataccctgaatggctcagggctggccgtaggccgtaccctggtggcggtgctggaaaattatcagcaggaagatggccgcatcactgtgcctgaggttttacgcccctatatgaatggcgtcgaaattatcggctaagcaacagtaactctctgaacccggccatggccgggttttttttatgttattgctcaggaaaaactgtttagtcaggcctcaatttaatcacaaataaacgttatcgataccagccaggccggaatggctaaaaacctaatttttcatagagatagcatttagcgacctgccgcttcttacgattgtaacccactgaagattagtaaattaaattgtcgcacagcaaaatgtgctgccgttaaaattcgcccattgactttaaaaaggccagtggcaaactgcgcgcaatttccttcatttgctctggtttctatcccctatgtcaacctggtcacgccccgtgatattgctgctttgcggcctgatgttaatgactgtcgcaattgccgtgctgaatacgctcgttccactgtggctgacgcatgacttactgacaacctggcaggtgggcatcgtaagctcctcctattacaccggtaacctcgcagggactctgctggctggctggttaatcaggcattatggcttcaaccgcagctactacctggctaccttgatgtttgccgtcgcgactctgtgcctggcgatgatgtcgggtttctgggcatggagttcaatgcgtttcatcgccggtgtcggctgtgcgctgatgtgggtggtggtcgagagcgcacttctgtgcagcggaacggtacgtaatcggggacagctgctggcggcctatatggttgtctattacatcggcaccgtgacaggccagttgctggtcagcaaactgtctacggaattactcagcgtgattccgtgggtgacgtcgctggtcttctgcgccgtgctgccactggtctttactcgcgtctccgccagcggtgaagcgacagaagccgctccggcccgcatctggccgatgctgcgtcgccgtagctcacgtctgggcatcaatggctgcattatctctggcatccttctgggctcgctttatggcctgatgccgctttacctgtcacatcagggaatgagtgatgccaatgtgggttactggatggcgttgctggtcagcgcaggcattgtgggccagtggcccattggccgtctggccgatcgttttggtcgcatgctggtgctgcgagttcaggtctttgtggttatcctgggggcgatggccatgttaaccaatgctgcgatggcgccagcgctatttgttctgggactggcaggcttcacactctatccggtggcgatgtcctgggcttgcgagacggtcgcacatcatgaactggtagcgatgaatcaggcactgctgatgagttataccgtgggcagtctggctggaccggcaatgacctctgttctgatgcaaaattattctgaccagctactgttcgtgatgatcgctgctgtggcgctgatatatctggtgatgctgctgcgcaaagcgaatcatcaggctacgccagtggcacatgcctgatcgctgaacagcaaaaagggagcgttaagctccctttttttgtggcagattcttcagtacatcacttcgtggccatagctggcgagaatgtttttcacgcgctccattgtctctttgctcggtggcttcaccccgtccagcttgtactcttcacccatcgcaatccatttatgcttacccagctcgtgatagggcagcaattcaatcttctcaacgttctccatgtcacgcgtgaattcacccaagcgatgcgcggtgtcatcatcgtcggaatagccgggcaccacgacaaaacggatccatgtccgtttgccttttttctgcaggtaacgggcaaagtccagcgtacggtgattagagacacccaccagaatctgatgcacgtcatcattcatctgtttcaggtcgagcatcactaagtcggtaacgtcgagcagttcatcgatcaccggatcatagcggcgtacgaagccgttggtgtcgagacaggtatgaataccttcggccttacaggcacggaaccagtcgcgcacaaattcagcctgaagaatggcttcaccgcctgaggccgtgacgccgccaccagaggcgttcataaaatggcgataggagagtacatccgccatcagcgcttcgacgctgatctctttgccaccgtgcgtatcccaggtgtcgcggttgtgacagtagaggcagcgcatcaggcagccctggaagaaggtgataaaacggataccgggaccatcgacggtgccgcaggattcaaatgagtggatacgaccgttaactgacattgcgatgttttctccagtaagtctgccgggacagacggcgcaatctctgttgcgctcagggcaggaaatcgattctggtgggaaccttgatggagatgaccaccagaacagacttttaattaaaaggctccgcgaggagccttttttatcaggtagagcagtaattacagtgacttagtgaaggttcgggtaatcacatcctgctgctgttctttagtcagtgagttaaagcgtacagcgtaaccggaaacgcgaatggtcagctgcggatatttctctggatgttccatcgcgtccagcagcatttcacggttcataacgttaacgttgaggtgctgaccgccttcgatgctggcttcgtgatggaagtaaccatccatcagaccggcaaggttggttttccgcacgttatcatctttacccagcgcgtttggtacgattgagaaggtataggagataccatctttcgcataggcaaacggcagtttcgcgacggaagtcagtgaggcaactgcacctttctggtcacgaccatgcatcgggttagcacctggtccaaacggcgcgccagcgcgacgtccatctggtgtgttaccggttttcttaccatataccacgttcgaggtaatggtcagaacagactgcgtcggcacggcattacgataggtgttcagctgctgaattttcttcatgaagcgttcaaccagatcgcaggccaggtcatctacccgtgagtcgttgttaccgaaactgcggatattcgccttcaatgtcgaagtcgatggccagaccatcttcgtcacgaatcggtttcactttggcatatttaatggcagaaagtgaatccgcagcgacggagagacccgcgataccacaggccatggtgcggtagacatcccgatcatgtaaggccatcagtgccgcttcgtagctgtatttatcatgcatgtagtgaatgatgttcagcgaagtcacatactgttttgccagccagtccatgaagtgatccatacgctccatgacggtgtcgaaatccagtacgtcgtcgctgattttgtcacctttcggtccaacctgcattttcagcttttcatccacgccgccgttgattgcgtagagcagcgttttcgccaggttggcacgtgcgccaaagaactgcatttgtttgccgacaatcatcgggctcacgcagcaggcgattgcgtagtcatcattgtcgaaatcagcacgcatcaggtcatcgttctcatactgcaaagatgaggtatcgatagagactttagcggcatattttttgaaattaatcggcagtttttctgaccacaggatggtcatgttcggctcaggtgaaggacccatggtgtagagggtattcaggaagcggaacgtactttttgagaccagggtacggccatcaacgcccataccagccagggattccgttgcccagattgggtcacctgagaacagctcatcatattcaggtgtacgcaggaagcgaaccatacgcagtttcatcaccagatggtcaatcagttcctgtgcctgctcttcagtcagtttaccggctttaaggtcacgttcgatgtaaacatcaaggaaggttgagacgcggccaaatgacatggcagcaccgttttgtgatttaactgcagccaggtagccatagtaagtccactgtactgcttcaaccgcattggtagccggaccggagatgtcatggccatattttgctgccatctctttaatctgggccagcgcacgatgctggtcagaaatctcttcacgcagacgaatggtcgcttccagattaacgccattctctaaatcttcctgcagtgaggcgaactgagcgaatttatccgccatcaggaaatcgatgccgtacagcgccacacgacgatagtcaccgataatacggccacggccataagcatcaggaaggccggtcaggatacctgatttacggcagcgcaaaatgtccggtgtataaacatcgaacacgccctggttgtgcgttttgcgatattcggtgaagatttttttcagtgaagggtcgagttcacggccatacactttgcatgacccttcgaccattttgatgccgccataaggaatgatggcgcgttttaatggcgcttcggtctgcagaccaacaattttttccagtggcttaatgatgtaacccgcgtcgtgcgaggtaatggttgaggcgagatcggtgtcgaagtcgactggcgcgtgggtgcggttctcaattttgatgccttccagcacgctttcccacagtttggtggtcgcttcggtggcacccgccaggaatgactcgtcaccttcatatggggtgtagtttttctgaatgaagtcgcgcacattgacgctattctgccattcgccttcagcaaatccttcccatgctgaagccagttttgcattaagttcggtcataatatacctgccttatatgaggagactttacggtcgggcacagccaacttcctgtgccgtcaaaaatgcgtttaatgaacccggtcacctttacggagatagataacccagtaggtcaacccaaccagaaacgccgccgccgataatgtttccgatggtcacgggaatcaggttgtcgataataaagttactgagggtcagcgagtgaaactgtgccgccgtggtgccagctgcctgccagaattcaggtgtcgcgaagtcacgaatagcaatggcatagggtataagaaacatgttggcgatactgtgttcgaaaccgcttgcgacaaacatcgcaacaggcagaatcatcacgaccagcttatcggtcagggtgcggcctgagtaactcatccagacggcgagacagaccagcagattggccaatgtacccagacaaaccgcctctatgaaggtgtgatgcatcttgtgatcggcagtttgcaggacattcaatccccaggcgccattcgcgatcatgtgctgtccggcaaaccacatcagagcgacaaagaaaagtgcacctgcaaggttaccggcgtagacgttaatccagttgcgggccagctgtccccagctgatgcggccactggctttggcgacaacgattaatacagtagaggtaaaaaggtcggcaccgcataccacgaccagcattaagccgagtgaaaagcagatacctccaatcagtttggctatgccgtagggcatcgcgccgctaccggtggtcgctgtaatataaaaaacgaatgcgattgagataaatacgccggcgtttattgccagaaagaaggtcgtaaaaggatgtttggttgctttatagatacccgcgtcttcggccactttcgccatcgcggcgggtaataaaagattaaaagggttgtcagttttcacactaacttactcctgaagttgtctgaaaaaatactaacaaaggagtataggtcagtaattgatatggatcatgtttgccagggtggtaacacactggtcgcaaattaatgagaaaattatgagttaactaactgaatataaacaaataaatttattttaaaaatacaaaaatattttaatataaagtgatgcgccacttttttagttcagtctgtgttattaattaatggcttatgtgttaattaaaatgatgtgatgtaataagaaggaattttaaagtagctaatgtttcatagagaaagtggggaatgatggcaccagataaatccagtgccatggttagccgtctgctttcagtcttacgcgttatggtttacgcgtttttccagtagtgacgtttggcgttttgcagtttttcgtaggcggcaagcagagactgatgggccgggaaggcctgcagctcatcatcaacagcctgaaggccgttaaacggattctcaccactgatcgcggctgaggctgcttccattgcgctctcaccatacatccgcaggaaagcgtgatgatactgcaatggatcacgctcatcttccatagccagtaacagcagggtctgcaggcaacgatagtagttagcgcgctctggcgtaaagattgagctgttaaactccatcgtccattctgtccagatcaatgcctgatccagatcgccgcccgccagcgccagcatcgcttttaattcgccaacacgcagcgtgtaccagccattgtctttaccggtcgccagacccagtagctcacgaacgcgggtgaagtcatcaaagccttcatcatcaagctgtccaatcagatccagatactcttccggattccagttgctgtcaggcagggccagcagggtttcacgcatgcccgctcccatgctgttgttcgccaggaacagatcttctgccggatagatatcagacatgcctggcacgatgatgcggcaggcatagacacccagatgctcgtagtctgcaatatagacttccttatcttccgaggcgaagattgccatcagcgtggcgaattcctgttcggtgctgcccgcgaatgaccagtcgacaaaaggataatccgcagtttctttaaacagatcccaggagatcaggccgcttgaatcgatgaagtgtgtttcaaggttggcatgctcagccacttcttcgtcatcaaaggtcggtggagtaaacacatccagatctttgaggcttcggccctgcagcaactcggtaacggtacgctccagcgccacaccgaaatcagggtgagcaccaaatgaggcaaaacaggttccgttggttgggttaaacagcaccacgcagataaccggatatttaccgccgagagaggcgtcataagcgaaaatcgggaagccttccgcttcaagacgtgcaatggcttcgatcacctcaggataacgctgcatcacgtcatctggaatcgcaggcaggctgatcgcttcagcaataatgcggtttttaatatagcgctcaaacacttcagacagcccctgaacacgcgcttcgttcgcggtattacctgccgacatgccgtttgagacatagaggttgccgataatattcatcgggatatagacagtctgctggtcggactgacgggtaaagggcagggcgcagataccacgttcagtattcccggactgcagatcaatcaggccggaagccgtcagtgcattatcgggatcgtaaaatgcgcgcaggcgtggatccagaataccttcaggtaaggactcatcatcaggtaatgcaaaccatttttcattgggatagtgaacaaaatcgccgttagcgatcttttttcccagccagaagtcagcaaaaaaatagttagttgagagacgctcgaaatactcgccaagcgcggaggccagcgccgcttttttactggcgcccttgccgttggtaaaacagagcgggcaatcgcggtcgcggatatgcactgaccagacatgggggacaggattcagccaggatgcttcttcaatgttaaagccaagatcctgcagcttgttctggaaacgcgcaatggagtcttccagtgcggcatctttgcccgggataaatgtttgcgtcatagtgccgctctctcagttgtcatagggtgcgtaaagcgcgcaatgatacggattttgctaacagaccgctatcagggcgggacatttttaccggcttactttaccggcttacttttcatcacttctgctctcaggccaaacgcggattaatggcgctggataaagcctcacaaaattccgcgcagatttgcattggtaacataacctccggcgagccagattcagaaaatgtgaccgctccctgatttatgattgcagctatcagaatgcagtgataaaaccggatggttattcataaccgttcgatatgacagtggtgaggggaaatgacgcaagtttataattttagctctggcccggcgatgctaccggttgaagtgcttcgtcgtgcagaacaggaactgacgaaactggcgcggtctgggtacctctgtaatggagatcagtcaccgcagtaaagagtttatccaggtggcggaagaagcggagcaggacttccgtgatctgctaaaaataccgtcgaattacaaagttttattctgtcatggcggggcgcgcgcgcagttcgctgccgtaccgggaaatctgctgggtaaagcgaccagtgccgactatgttgatggcggttactgggcgcatagcgcaataaaagaagcggaaaagtattgttccccacgcacgctggatgtcaaaactacgcgcgacggtaaacgagccatcctgccgatgagcgaatgggaggtgagtgagacgtccgcttacctgcatttctgcccgaatgaaaccattgatggcatcgcgattgacgaacagcccgactttggcagtaaaaccgttgttgctgatttctcatccaccattctgtcacgccctatcgatgtgagtcgttacggtgtgatttatgcgggtgcgcagaaaaatgtgggcccggccggattaacgctggttgtcgttcgcgaagatctgctgggtcaggcgcacgcctctgtgccctcaatcctcgattacaaagtgctggccgataacgattcgatgtttaacaccccgccgacttttgcgtggtatctctcagggctggtgtttaaatggctgaaagagaagggcggtgtcgctgaaattgatcgtatcaatcaggcaaaatctgacctgctttatggcgtaatcgatcacagtggcttctatcgtaatgatgtggcaacagaaaaccgctcacgcatgaacatccctttccagctggccgatgcttcactcgatgcgctgttcctggaggagtcgtttaaggcgggattacacgcgcttaaaggccatcgtgtagtaggcggtatgcgcgcctctatttataatgcgatgccgctggaaggtgtgaaggccctgaccgatttcatggtcgattttgaacgccgtcacggctgattattaagatatcagcattgatgctgatgccagacctcgtcacacggcgaggtctctgtattttttgaggatttcgtttcacatgcaggactccctgactctccaaccgattgcgcgcgtcaacggcacggtaaatctgcccggctcaaagagcgtttccaatcgtgcattgctgctggctgctctggctaaaggtacaacccgtcttaccaacctgctcgacagcgacgacgttaagcacatgctgaatgcgctgaccgcgcttggtgtaagctatacgctttccagcgatcgcaccctgtgtgaagtgacgggaaatgccgggccactgcacgcatctcaaccgctgtcactgtttctgggcaatgccggaaccgcaatgcgtccgctggccgcggcgctttgtctgggccagcacgatatcgaactgaccggcgaaccccgcatgaaagagcgtccaatcgggcatctggttgacgcacttcgtcagggcggagcaaccattgagtacctggaaaacgaaaactatccgccgctgcgtttacgcggtggttttaccgggggtgaagtcagtgtggatggcagcgtttccagccagtttcctgacagcgctgctgatgaccgcgccgctggcacagcaggatacctgcatcaccatcaaaggtgatttggtgtcgaaaccttacatcgatattacccttaatctgatgcagtgctttggcgtcgaggttgagaatcagaactatcagcgcttcctgatcaagggacagcaacagtatcagtcgccgggtgattacctggttgaaggcgatgcctcttccgcgtcctatttcctggccgctgccgctataaaaggcggaacggttcgcgtcaccgggattggacgccagagtgtgcagggtgacatccggtttgctgacgtgctggaaaagatgggcgcgacgattgagtggggcgatgattacattgcctgtacggccggaaaactgcaggccatcgatatggacatgaaccatattccggatgctgcaatgaccatcgcgactacggcgctatttgcagagggcactacccggttacgcaatatttataactggcgggtaaaagagaccgatcgactgagcgcaatggccacagagctgcgtaaagtcggggcagaagtcgaagagggtcatgactacatccgtattacgccgccagcgacgctgattcatgcggatattggcacctacaatgaccaccgcatggcgatgtgtttctctctggttgcactttctgataccccggtgaccattctcgatcctggctgtacggcaaaaaccttcccggactatttcgttcaactggctaaaatcagccagagcgcctgatatctccccttccggtgcggttcgcaccggaactcccctgattttatctggctgtaacaggccagagatcctctgaattgactaagattacgaacctgatcagtgcgaaagggtaaccaagccgtgctatgcagcgtataatgctagtcattaatggtgaccgaaaggtcaggaagcacgcagcaacaggagggaataatgacagtaactgccccggtcataactattgatgggccaagtggagcgggaaagggaaccctgtgcaaagcgatggcggaatcgctgcagtggcatctgctggactccggtgctatttatcgcgtgctggcgttggccgcattgcatcatcaggtggagattgaatctgaagaggcgctggtgccgattgccgctcacctggatgtgcgctttgtgtcacaaaatggtgaaatgcaggtcatacttgaaggtgaagatgtcaccggtgaaatccgtactcaggaggtcagcaacaccgcttctcgtgttgccgcttttccccgggtacgcgaagcattattgcgccgccagcgcggtttccgcgagatgccgggcctgattgctgatggccgtgatatgggcaccgtggtttttccggatgcgccagtgaaaattttccttgatgccagcccggaagagcgtgctcagcgccgtatgctacagttgcaggataatggctttaatgttaactttgaccgccttttagccgagataaaagaacgcgacgaccgcgatcgtaatcgcgcaattgcgcctttagtagccgctggcgatgcattggttctggactctaccgagatgtctatcgatcaagtcattgaaaaagcgctacaatatgcccgcgagaagctgggtattacggcttaactgaatctaccaccctgtaccatggatccggtgccgggcatgtgaaacaaccccatccgacatgaagtcagatggacgttaaattgaagaatcctgaagattatcaatatgactgaatcttttgctcaactatttgaagaatccttaaaaacaatcgaaacccgcccgggttctatcgttcgtggcatcgtcgtttctatcgacaaagatgtcgttctggttgatgcgggtctgaaatctgaatctgcaattcctgcagagcagttcaagaacgcagccggcgaactggaaatccaggtaggcgacgaagttgatgttgctctggatgcagtggaagacggcttcggtgaaaccctgctgtcccgtgagaaagctaagcgccatgaagcatggatcacgctggagaaagcttacgaagacgctgaaactgttaccggtgttatcaacggcaaagttaaaggcggcttcacagttgagctcaacggtatccgtgcgttcctgccaggttcactggtagatgtgcgtccggtgcgcgatacgctgcacctggaaggcaaagagcttgaattcaaagtgatcaagctggatcagaaacgcaacaacgtcgtggtttcacgtcgtgcggttatcgaatccgaaaacagcgcagagcgcgatcagctgctggaaaacctgcaggaaggcatggaagtcaaaggtatcgttaagaacctgactgactacggtgcattcgttgatctgggcggcgttgatggcctgctgcacatcactgacatggcatggaaacgcgttaagcatccaagcgaaatcgtcaacgtgggcgacgaaatcaccgttaaggtgctgaagttcgatcgcgagcgtacccgtgtttctctgggtctgaagcagctgggcgaagatccatgggttgctatcgctaaacgctatccggaaggtactcgcctgaccggtcgtgttaccaacctgactgattacggctgcttcgtggaaatcgaagaaggcgttgaaggtctggtacacgtgtctgaaatggactggaccaacaaaaacatccatccgtctaaagttgttaacgtaggcgacgtggttgaagttatggttctggacattgacgaagagcgtcgtcgtatctccctgggtctgaagcagtgtaaatctaacccatggcagctgtttcgctgagacgcacaacaaaggcgatcgtgttgaaggtaaaatcaagtcaatcactgacttcggtatcttcatcggcctggatggcggcatcgacggtctggttcacctgtctgacatctcctggaatgcgactggcgaagaagccgttcgtgagtacaaaaaaggcgacgaaatcgctgccgttgtactgcaggttgatgcagagcgcgagcgtatctctctgggcgttaaacagctggcagaagatccgttcaacaactacatcactttgaacaagaaaggtgccatcgtcaccggtaaagtgactgcagttgatgctaaaggtgctacagttgaattagcagacggcgttgagggttacctgcgcgcttctgaagcttcactggaccgcattgaagatgcaactctggttctgaacgttggcgacgacgttgaagctaagttcaccggcgttgatcgtaaaaaccgtgtcgtaagcctgtctgtccgtgcgaaagaccaggctgatgagaaagaagctatcaatactgttaacaccaaacaggaagaaggcaatttctctagcgctatggctgaagcgttcaaagcggctaaaggcgagtaatcggcctgaagcaccgggtgggcaaccacccggtttcggtaaaagctgtcatacattcccatagggataaaccggaggttacatgaccaagtcagaaaactgatcgaaagactggcgggacagcatactcatataccggcgaaagtcgttgaggatgcagtaaaagagatgcttgagcacatggccactacgctggcacagggcgaacgcatcgaaatccggggattcggcagcttttctttgcactatcgcgctccgcgtactggacgtaacccgaaaacgggtgacaaagtggatctggaaggtaaatacgttccccactttaagccgggcaaagagctgcgcgatcgcgcaaatatctacggctaagccgataccgaaccagataaacgacatctccggatgtcgtttttttttgcctgcgattcaggctcagatctgacatccggattgctgtcatcaacactgcaacgccgcactctctttgtgagagcgctccagcctgcctgatcatccgctgttacttttacctcctttgcccagaataatcgaactgaatcaatggatacgattatgctgacatggacctttctggcacgactggcgatcgttgcaacgttaccgctactgctgatggcccggctgccttccggtgaggtgatgtggggcttcctcctcacaggactggctctgctgcattgcccttaccaacccgtccgtctggccggtattactctgctgttgctggcatgggcctgtaacgacgcccgtctgatggtgcgggatatcgaaaagttctcggcgcgtcctgccacctacacccttcagatcagtgaactgcggaaagagcggaagcaaatccgggttcgtctgttgaaagaggagggcaggatgatttttccgcctcgctttgcctggatctggtttgatgctgatccggaggtctactgtccaggacaacgctggacgatgaaactgcgtctgcgaccggtacatgcccgccttaatgagggcgattttgatgcgcagcgtttcgcactggctaataatacgccgcttcagggacgaatccttaagcagactgcggtaagcgatcgctgtgatagccgctggcgatttattttatggcatcgtgacaggacccgtgcaatgcctgcacgtgcaacgctggaggcactggcttttggcattcgggatgagatgagccagcagacgcgtcagctactgcgggataccggtaccgcgcatctgatggcgatatcgggcatgcatatcgccctggccgccagcaccggctggatgattgcgcgtggggtgcaatttatcttgccagcccgttatatcagctatcttttccccctcatcgtgagctggctgtttgctgcaatctatacctggctctccggtgcacagcctcccgcagagcgttcgctgcttgccctgacgctatgggcgataacacggtttgcgggtgttcagctgaatagctggcaggtctggacgttctgtattgcgttgctgctggtaaccgacccgctgaccgtgctctctgacagcttctggctctcggtactggctgtgggcatgctgctggtctggtatcactggttcccgctgcctgcggcgttccgtcagcaacggcgctggattccggtacagctgctgcatttacaggcgggcatgatgattttaatggtgccgttgcaggtggcgattttcaacggcatcagcctgactgcgctggtggcaaatgttgtcgcgattccggtcgtctcgtttattaccatgcctctggtgacgctcgccctgctgctgccggtggcgcatttatctggcttcttctggggagcggccgatctctctttacgtgcactgtttcattgcctgacgttgctgccaccaggctggtggccgctgagtggcacaacctggtttacggttatggtatggggcggcctgattctctggcgtgcgcagctcttcttctctctgccactaagcagctgcgccttagcgctggcgatgatactgagtcgccagccaaatcaggagcagggctggcgcatcgatatgctggatatcgggcacggtctgagtctggtgatcagccagggcgacgaggcggtgatgtatgacaccggcccgcgctggcagaaacgataatgcggggagtcgggtgatcattccatggctggagcgcaggcagctacggttaaaacaggtcatcctgagtcataaacatctggatcatactggcgggctggcggcgattactcaacgctggccagcggttgaagtcagaagtgcgctggctgatgaggcacacttaccctgcgtacggggcacgcagtggcgctggcggcagctccactttcgggtggtctggccgctgacggcacccctgccgggcggaaataatgactcctgtgtggtgatcgtcgatgatggtcaggtccggctgatgttaaccggtgatattgaagcgaaagcggaacgccagctggtggcgctggagaagcaggggctgaaggtcgatattctgcaggtcccgcaccacggtagccggacgtcgtcgacctcattgctgctgcgtaaagccgcaggccacaccgctatcgcctcgctggcacgctacaatgcatggcgtatgcccgcgaaaaatgtgctggaaaactatcgaacggccggttttcagtggctggatacgggccagtcaggacaaatcagtatcaggatagagcagggcagagcgcaggtttctaccctgcgggaacaattaatgccccgttggtatcatcagtggtttggcgtcaaacgcgaatccaggtagaatggccggctatttccaacagcgtgaataaataatgcatcaagataaagatctctctacgtggcagacgtttcgccgactctggccgatgatcgcgcctaataaagcgggattaattgcggcctcagtcgccctgattattaatgctgcgggcgacgccttaatgctctcactgttgaaaccgttactggatgatggttttggtaaagctgacagatcggtgatgctgtggctgccgttagtggttattggcctgatgctggtccgcggagtcaccagttatatctccagctactgcatctcctgggtctctggcaacgtcgtgatgaacatccgccgtcgtctgttcagccatatgatgggcatgccggtttcgtttttcgaccagcagtcaaccggcaccttgttgtcacgcattacttacgattctgagcaggtcgcctcctcttcttcgggcgcgctggtcaccgtagtgcgcgaaggggcttccattattggcctgtttatcatgatgttctactacagctggcagctgtcgctgatcctgattgtactggcacctatcgtctcctttgctatccgcaccgtctctaagcgcttccgcaccatcagcaaaagtatgcagaatactatgggtcaggtgacaaccagcgccgagcagatgctgaaagggcacaaagaagtgctgatttttggcggacaggacattgaatcggagcgcttttcccgcgtcagtaaccggatgcgtcagcagggaatgaaactcgtttcagcctcctccatttccgatccgattattcagctgatcgcgtcgctggcactggcttttgtgctctatgccgccagcttccccagcgtcatggataccctgacagccggtaccatcaccgtggtcttctcctcgatgattgccctgatgcgcccgcttaagtctctgaccaacgtcaacgcccagttccagcgtgggatggcggcctgtcagacactgttctctattctggatagtgagcaggaagtggataacggtacgcgcgaaatcacccgtgctaaaggggatattgaattccgtgatgtcacctttacctacccaggccgtgaaattccggcactgcgtaatatcaatctgtcgctgccggcaggaaaaacggtggcgctggtgggccgttcgggttccggtaagtctacgatggcgagcctgctgacccgcttttatgacatccagcagggcgaaatcctgctggacggtcatgatctgcgtgagtacagcctgcgctcattgcgtaatcaggtggcgctggtgtcacagaatgtgcacctcttcaacgacacgattgccaataacatcgcgtatgcccgcagtgagcaatacagccgtgaagagatcgagcaggcggccaccatggcgcatgccatggactttatcaataaaatggataagggcctggatacgatgattggcgagaatggcgtgctgttatctggcggtcagcgtcagcgtattgccattgcccgtgcgttattacgtgattgcccgatcctgatcctcgatgaagccacctcggcgctggataccgagtctgaacgcgcgattcagtctgcactggatgagttgcagaagaaccgtacctcgctggtgattgcgcaccgactctctaccatcgagaaagcggatgaaatcgtggtaattgaagatggccagattgttgaacgcggtacgcatcaggtgctgttagcagaaacgcggtgcctatgcacagctgcacaagatgcaattcggccaatgattgaacgtatctggagtggtcgctcaccgctatggctgctgctatggccattcagcctgctgtatggtgcgatcacggccctgatacgcttcagttacaggcgcggctggcgtaaaagctggcgtgcgcccctgccggtcgtggtggtgggtaacctgactgctggcgggaatggaaagacgccggtggtcatctggctggtcgaggcgttacagcagcgcggcctgcgcgctggcgtggtctcccgaggatatggcggcaaggcggaccactatcccttgctggtcacggcgcagacccccaccgaacaggccggggatgagccggtattgatcgcccagcgcaccggggcgccggtcgcggtcgcccctcaacggcgacgggcgattgaggcgttactgaaacagggttcgctggatgtgatcatcacggatgatggcctgcaacattacgccctgcagcgcgatcgcgaaatcgtggtggttgatggggtccgtcgctttggtaatggctggtggttgcctgccggtccgatgcgtgaacgtgccgatcgtctgcagcaggtcgatgccgtgatcattaacggcggcgaagcacagcccgacgagattgccatgcaacttcagcccgggctggccaccaatctgctgaccggtgaaacctgcccgccggagcaactgggtgcggtagtcgccatggccggtattggtcatcccccgcgttttttcaccacgctgaaacagcagggtataacgccggtcgcagagatcgcctttgccgatcatcatgcctacagcaaagatgaactgacccgattactccaggcgggtcagcaactgctgatgaccgaaaaagacgcggtgaaatgccgtcactttgcccagcctgactggtggtatttgccggtcgatgcccatttaactggtaatgccgtgacgccgttactggatgacattgaacaactctgccgccatatttcctgatacccgcccccgttcaggtgaagcctgataaggaagaggatgaacagtacgcattcactttcgttacagcaagcacgccaccttcatctcgccgcgcagggcctgctgcgaactccggcaaaacgtgctgtttatcaggatctgattgactgcatttcccgcatgtcgctgctgcaaatcgataccattcatgtggtggcccgtagtccgtatctggtgctgttcagtcgcctggggaactatcctcaggcatggctggaacaggctctggcacagggcgaactctttgagtactgggcgcacgaagcctgctttattccccgtgccgattaccgacttcttcgtcatcgcatgctgtcgccggaacgtctgggctggaaatacaatgcgcaatgggtcgctgagcaccagcaggccattgccgaattacttcagcagatcagagacaacggcccggtacgcgccgccgattttacccatgccgataacccgaagtcaggctggtgggcatggaaaccgcacaaacgtcatctggagaatctcttcagcgccggtgagctgatggtcaccgaacgccgtaattttcagcgcgtctacgatctgcgcagccgcgtgatgcccgactggcaggatgcgatacatggcatcagtgaagcggaggcgacccgtcagatgctgatgaatagcgcccgcagcttaggggttttccgctcggcctggctggcggattactatcgcctgaagcgggcacccgtgaacaactttatcgctgacgcccaggctgcgggcgatctggtcgccgtcaatacagagggactaggtgagatgtggctgcatcgtgactacgtgccgttgctggatacgccgctgcaggcgacgcacagcgcgctgctgtcgccgtttgatccggtggtctgggatcgcaagcgtgcgcgtgagctgttcaattttgactaccgtattgagtgctataccccagaggaaaaacgcaaatttggctattttgttttgcccatcctccatcgcggccagataaaagggcggctggatgcccgcatgctgcgtcaggcaaaacagctggagattaaaaatatctggctggaggagaagacccgcgttacggcgcgatttttgctggatatccggcgtgctatcgaacgcttcgcgacgtggcagggtgctgaaagtgtcgctatcctgcaggcacccgacgcgcttaacgatcagtggccagccctgtggacgctggattaatcaattttgcggcagccgctgcgggatggcgttttaccccatcccgcacgcgccgcgctatggtatgcttgaatccttaagcattcggtccctgatggaggacatatggatcatcgtttactcgaaatcgttgcctgcccggtttgcaatggcaaactctacttcaacaatgctcaacaggagctgatctgcaaacctgatggcctggccttcccggtccgggacggcattccggtgctgctggaaaccgaagcccgcacgctgtcagttgaagagattcatccatgagtttcaccgctatcattcctgcgcgttatgcgtcaacccgcttacccggcaagccgctgctcgatatccacggtaaaccgatggtcgtgcatgtaatggagcgggcccgtgaatcgggagccagccgggtcattgttgccaccgatcatcccgatgtggcgcagtcagtggaagcggcaggcggcgaagtctgcatgacgcgcgccgatcaccagtctggcactgagcgactggcggaagtgatcgaaaaatatcagtttgccgatgatgaaatcatcgtaaacgtgcagggcgatgagccgatgattccggccgagattgtgcgtcaggtggcaaccaatctggcggggtcggcggccgggatggcgacgctggcggtgccgatcaccgatgtggaagaagcctttaatccgaatgcggtgaaagtcgtcatggatgtgaatggctacgcgctctatttttcacgggcgactatcccctgggatcgtgaacggtacgccgcatcgcgcgagcagatcggtgatacgctgctgcgccacattggcatctacgcctaccgtgctggttttattcgccgctatgtcgcctgggcgccttgtcctctggaacagattgagctgctcgagcaactgcgtgttttatggtacggcgaaaaaattcatgtcgccgtcgcgaaaaccattcccagtgtgggtgtggatacgccagacgatttgcaacgcgtttcgtgatgccatgcaggcctgacaaatggggagcctgtctccccgtttcaacgcaacgttcttgatccgccgctaaacttatctccaacacttccttcaggatattgtgatactcatctgaggaggatgccgcatggaacagcttaaatcggaactcacgctggcgctgggtgaaaccatcagccgcctcgaaatgatcagtgaacatccacccacccggctttatgcgttatacgatcgggacgggcgccccatgccggtggtggcgaaatattttcgtcatcagggccgggcggcgatggaagccagaaagctggcgctgctgggccaggccggactgattgccgtgccagcggtctatggtctggtgatgagccagcagccgccggtgcatgaaatgctcctgctggcgcgactgaatggcgtgacggcggaagcgcctgcgcgggatgctcagcgctggcaacagttttgcgaacaggtggtcgagggagtgctggcctggcaccggctcgacagccatggcctggtcggtacggtggacagcacgcagcagaacagctggcccgcctggtatgcacaacgggttgaggtgctatgggcgaccctgagctatctgcgtcctccagcctttacgctggaagatcgtcagattctgtttcgctgccgggcacgactggcgcatctgtttcgcggcttcgacgatccctgcgtgatggttcacggcaacgttcagctgcagagcatgctgaaagatagccgcagtgaccagttaatcgcgatgacacagccgggcaccatcctctgggcaccccgtgaatacgatcttatccatctggatacctcgcctgcagaaacggcgctgctgcacagctacctgcaacgggcgccggtttcagagggttttgtctggcgtcggtgggtttatcaactgtgggactgcattgagcatctggtacagaccggcacttttaatcgtccgcgttttgaccatgcacgcgcgcaattacttccctggctcggctgagtccgactcctcgcctttcagccgttgcaatagtgtgccaagcgtttcgtagaccgcacgttcgctgtgactcagccagatcgatgagggtatcgcccgctcccatccattcagcggtgacgtaatcgccagctgattcgcgggagcggccattggcttcaacccgatcgcgtggaaaaagcgtattgcgcgcggcatatgattcgcggatgtgaccagcagaaacgggcgatcgcccaccacggttttgaccgcctgcgcttcatccgcggtgtcgcggggctggtcgagaatctgaacatgttcgcggggaacgcccagactttccgccacctgtgccgctacccaggcgctactctttggattggtgccgcccgctgcgccggtaaaaatcagcttcgactgcggattccgctgccactgacgaacgccttctgccacgcgcggcagactgttattcagcaggttcgagctgggtgcccacgccgggttaaaggtgtagcctccgcccagcaccacaatgaagtccaccttctctgatccgttccaggtcggatagcggctatccagcggcaaaagcagacgatcggccagcggttgcaggctcagcagcagcagtaacagccagctgacggagatcacggttttgccgcttttctgccagccagtaaaccaaagcagtaaaatgccaagcgccatcagcaaaagcagaaacggcaggggtaaaagcagcccgccgataacttttttaagggtaaataacatcaaaaaagagtcctgttgtccgaaaatagagcacccggaagggaagatggggatgaaaggttcattcttctggtgcctgtgacaaaatagcacaagtctcaccgcagcataccggagcgcatgccatgcaggatcgtaactttgacgatctcgcggataaattttcgcaaaatatttacggcaccactaaagggaagatacgccaggccatcctctgggatgagctggagaagatagtgcccggtctgtcaccgcacccgctgtcggtgctggatgctggcggcggtgtcggccaggtctccagcgggcttgctgcgcagggccatcaggttctgctgtgcgacctttccagcgagatgctgcgccgggccgcggaaaatgcagcggcacagggtgtgagccacaacatgcaattcagacaaattagcgctcagcaggtgggcgaacatttggataagccggtggatctggtattgttccacgctgtgcttgagtgggtcgctgaaccggagaaggtgctgaaagcgctgtacgatctgctgcgtccggggggcgtcatgtcgctgatgttttacaatctgcacggcctgacattgcgcaccttaacgctgggtaacttcggctatctgcgcaccaacctgaccaaacgcaaaaagcgaacgctgtcgcctgactatccgcgcgaccccgagcaggtctatcgctggctggaggcgtgtggctttgtgattgagcagcgtgccgggatccgggtgttcagtgactacatgaagccgccgaagggcgagccaaaaagcgacgacgaaattattgagatggagcggcgttactgccgtcaggaaccctttttgagcttagggcgctacatccacgtgaccgcgcgtaaacccgggcagaaggacgaattatgagtgaattttcccagacggtacctgaactggtctcctgggcgcgcaaaaatgacttttcccttgcgctgccagtggaacgtctggcctttttgctggctatcgccaccctcaacggtgagcggatggatggcgaaatgagcgaaggcgatctgattgatgctttccgtcacgtcagcaaagctttcgaacaaacccatgaaaccgtgttggttcgtgccaacaacgccatcaacgacatggtgcgacagcgcctgctcaaccgttttaccagcgaaatcacggaaggcaatgccatctatcgcctgacgccgctggcgatcggcatcactgactattacatccgccagcgtgagttctcgactctgcgcctgtcgatgcagctgtcgattgtggccaatgagcttaagcgggcagccgatgctgcgcaggaaaatggcgatgagtttcactggcaccgcaatgttttcgcgccgctgaaatattccgtggcggagatcttcgacagcatcgatatgacccagcgtctgatggatgaacagcagcaggcggttaaaaatgatatcgccgaactgctgaacaaagactggcgcgcggccatctccagctgtgaaatgctgctttctgaaacctcaggaacgctgcgtgaactgcaggatacgcttgaagccgcgggcgacaaacttcaggaaaatctgctgcgcattcaggatgccacgctggacagtcccgatctgggcttcgtcgataagctggtgtttgatctgcaaagcaaactcgaccgtattaccagctggggccagcaggcgattgacctctggatcggctatgaccgccacgtccataaatttattcgtaccgccatcgacatggataaaaaccgcgtctttgcgcagcgcctgcgggtatcggtgcagaattacttcgatgcgccctgggcgctgacctatgccaacgccgaccgcctgtatgacatgcgtgatgaggcgctgacgctgcgtaacgacgaagtgatgggcgaactgccgccggagatggagtacgaggagatcaacgaaatccgcgaacagctggcagcgatgattgaagaagcgctgcaggtctacaaatcgcaacaaaaaccgctcaacctcgcgtcagtgatgcgcgactacctggcccagtatccccgagcccgccatttcgatctggcgcgcattgtggtggatcaggcggtgcgccttggcgtagcggaagctgatttagccggtttgcctgtggaatggcaagccatcaatgattacggagccaaggtgcaggcacatgtcatcgacaaatattgaacaagtgatgccggttaagctggcacaggcactggccaacccgatttttcccgcgctggacagccagttacgcgccggacgccatatcggtatcgaagagctggataatcacgcttttctgatggactaccagtcgtttctcgaagagttttacagccgctataacgttgagttaatccgtgcgccggaaggctttttctatctgcgtccgcgttcaaccacgctgattccgcgttccgtgctctctgagctggacatgatggtcgggaagattctctgctatctctatctcagcccggaacgactggccaatgaaggtatcttcacccagcaggagctgtacgacgaactgctctctctggccgatgagaaccgcctgctgaagctggtcaaccagcgctcaaccggttcggatctggatcgcaccaaactgcaggagaaagtgcgcgcctctctgagtcgtctgcgtcgccttggcatggtgtggtttttcggcaacgacagcagcaagttccgcatcacggaatcggtgttccgctttggtgccgacgtgcgcggcggtgatgacgcccgtgaagcgcagcttcgtctgattcgtgatggcgaagccatgctactggaaaacgcgacagcaccggtcgacaccgatgacggtgaaggtcaggaaggcgacgcgagtgagaaacgcagaggaagaacaggcatgattgagcgcggaaagtttcgttcgcttacgctgatcaactggaacggcttttttgcccgcacctttgatctcgatgaattagtgaccacgctgtcaggcggtaacggtgcgggtaagtccaccacgatggcggcatttgttaccgcgctgatccccgatttaacgctgctgcacttccgtaataccaccgaagcgggcgcgacatcaggatcccgtgacaagggtctgcatggtaaactgcgggctggggtctgctactccatgctggatgtggtgaactcacgccatcagcgtgtcgtggtcggtgtccgtctgcaacaggtcgccggacgcgataaaaaggtcgatatcaagccattcagtattcatggcctgcccaccgacaccaacccaaccgatatgctgacggaagtgcttaacagccgtcaggcacgcgtattaccgctgaacgaagtcaaagagcgggttgaggcgcaggaaggggtacagttccgcgcctataactcagtcaccgattatcacgccatgctgtttgatcttggtgtggtgccgcgtcgtctgcgctctgccagcgatcgcagcaagttttatcgtctgattgaagcctcgctgtatggcggtatctccagcgccatcacccgatcgctgcgtgattacctgctgcctgaaaacagtggcgtgcgcaaagcgttccaggatatggaagccgcgctgcgcgagaaccgcatgacgctggaggcgatccgcgttacccagtctgaccgcgatctcttcaagcatctgatctccgaggcgaccagctacgtttcggctgactatatgcgccacgccaacgagcgtcggggacacctcgacagcgcgttacagctgcgcagcgagctgttcagcagccgtaagcagctcgccaccgagcagtatcgtcatgttgagatggcgcgcgaactggctgagcacagtggtgcagaaaacgatcttgaagtcgattatcaggccgccagcgatcacctgaacctggtacagacggcgatgcgtcagcaggagaagattgagcgctacgatgcggatatcgaagatctgacgctgcggctggaagagcagaccgaagtggtcgcagaagcgcgtgaaattcaggaagagaatgaagcgcgggccgaagcggctgagctggaagtggatgagctgaaaagccagctggccgatttccagcaggcgctcgacgtgcagcaaacccgcgccatccagtatcagcaggcattgcaggcgctggaaacgcgcccgcacgctctgccagttacccgatctgagcattgaaaatgcggctgaatggcaggaaagcttccaggccaaagaggaagaggcgacagaacggttgctgcgcctggagcagaagctgagcgtagcggaagcagcgcacagtcagtttgaacaggcgctggcgctggtgaccagcattgccggtgacgtgacccgtcaggacgcctggcaaaccggccgcgaactgctgcgtgatgccagcaaccagcgtcatcacgccgaacagctctcttcgctgcgtctgcgtctcaatgagctggaacagcgtctgcgcgagcagcatgaggcggagcgcctgctggcggaattctgcaagcgtcaggggcagcattatgaagcggatgcgctggcaggcctgcagcaggagcttgaagcacagattgaacagctgaacagcagcgtctccgacgccggtgagcaacgcatgatgatgcgccaggagctggagcagctgcgcgaacgcatcaccagcctgaccgcccgtgcgccacactggctggcggcgcaggagatcctgacccagcttagcgaacagaccggtcaggcgctgaacagcagccaggacgtgaccgaatatatgcagcagctgctggagcgtgagcgtgaaaccaccgtcgagcgcgacgaagtagcggcgcgtaaacgtgatatcgagcagcagattgagcggctcagccagccgggcggtgccgaagatgcgcgcctgacccagcttgccgaacgttttggcggcgtgttgctgtcagagatttacgatgatgtaacgctggatgatgcgccttacttctcggcgctctacggtccgtcgcgtcatgcgattgtggtgccggatctctcgcgcgttcgtgagttgctggatggtctggaagagtgtccggaagatctctacctgatcgagggtgatccgcagtcgttcgatgacagcgtcttcagcgtcgatgaactgcagaatgcggtggtggtgaaggtggcggagcgtcagtggcgctactcccgcttcccgaaaataccgctgtttggccgcgcggcgcgtgagaatcagctggagctgctgcaccttgagcgcgataagctggccgaacgctacgccacgctgtcgttcgacgtgcagaaaacgcagcgtctgcatcagtcattcagccgcttcatcggcagtcatctggccgtcgcctttgacgccgatccggaagcgcagatccgtcagctcggcgcacgccggggtgagctggagcgcgcgctgaatcagcatgagagcaacaatcagcagcagcgtcagcagtatgagctggccaaagagggcgtatcacagttaaaccggctgctgccacgcgtcaatctgctgctggatgagacgctgggcgatcgctgcgaagagatccgcgagcaggtcgatgcggcacaggaagcggcgcgcttcctgcatcagcatggcgctaagctggcgaaactggaaccgatcatcgccgtgctgcagagcgatcctgaacagcatgagcagttacaggcggattatcagcaggcgcagcagcagcagcgcaacgcgcgtcagcaggcctttgccctgacagaagtggtgcagcgtcgcgcccacttcagctacgacgactcggccagcatgctcaacggcaacaacgacctcagcgataagctgcgtcagcgtctggagcaggctgagggcgaacgcagccgcagtcgtgatcgcctgcgtgaacatcaggcgcagctgacgcaatactcccaggtgctggcctcgctgaaaagcgcctatgacgccaagcgcgacatgctgaaagagctgcagcaggagatgcaggacattggcgtccaggctgacagcagcgcggaagaaacgcgcgcgcgttcgccgtgacgaactctacacggcgctgagtcacaaccgcgcccgccgcaatcagctggagaaacagcttaccttctgcgaagcggagatggataacctgcagaagcgactgcgtcagctggagcgtcagtatcatcaggtgcgcgaacaggtggtcagcgccaaagcgggctggtgtaccgtactgcgtctggtgaaagagaatggcgttgagcgtcgtctgcatcgccgtgaactggcctacctgagcggcgatgagctgcgctctatgtcggataaagcgctgggtgcgctgcgtctggcggtagcggacaatgaacatctgcgcgacgtgctgcgactgtcggaagatccaaaacgtccggaacgtaaaattcagttctttattgcggtttatcagcatctgcgcgagcgtattcgtcaggatattattcggactgacgatccggtcgaagcaattgagcagatggaaatcgagctgaaccgtctgacggaagagctgacggcgcgtgagcagatgctggcaatcagttcgcgcagtgcggccaacatcatccgtaaaacgatccagcgtgaacagaaccgtatccgccagctcaaccagggcctgcagaccgtcagctttggtcaggtacgcagcgtgcggctcaacgtgaacgtgcgtgaaacccacgccatgctgctggatacgctgtcggaagagcacgagcagcatcaggatctctttaacagcaatcgcctgaccttctctgaggcgctagcgaagctctaccagcgtcttaatccgcatatcgacatggggcagcgtacgccgcagaccatcggtgaggagctgctggactaccgcaactatctggagatggaagtggaagtcaatcgcggttccgatggctggctgcgcgcagagagcggggcgctctcaaccggtgaagcgatcggtaccggtatgtccattctggtgatggtagtgcagagctgggaagaagagtcccgtcgtctgcgcggcaaagatatttcgccatgccgactgctgttccttgatgaagcggcccgtctggatgcccgctccatcgccacgctgtttgaactctgtgagcgactggagatgcagctggtgattgcagcaccggagaatatcagtccggaaaaaggcacgacctacaaactggttcgtaaggtgtttaataacaccgagcatgtgcatgtggtcggtctgcgtggttttgctgccgatccttcgccggtgcgggcgggaagcgacgcagatgcgctgcccgatttaaccgctgaaaattcgcaggcggaaacgtagtcaaaaactgaaccattcgttaatctggttacggcatttgtcacatgaggcaaatgccgtttttgtttgtatactcacatgatgagtcacggcgcggtcgcagtggatacagggaacactgcgaagttgaaaaacaagggggcagggatgttgctggtaaaaaaattaaatcatcatcgcgttctatcattgttagcgctggcgctaaccgttgttccatttacgctaccgcaggccgctgttatcgccgctttgcccgggacaacgcaggcggtcacctccgtctccgaaagtcagcaacgcatccggcaggcgttttccagcgccgatcagccgttttatctggcaccgctggcgacgctctatgcatcccgccatatgcaaccgctctggcaggatcccaaggcgatacaaaaatttcagcagcagctggctgaagtggcactttccggtgttcagccacagttcacgcgctggattgagcgtctgacaaacccggcgatcaccggctttgcccgggatgtcgcgctgtccgatgcgatgctgggctatctgcaatttgtttcgaatgtgccgacgcagggtgaaacctggctttacagcaatgttccctaccggctgacacagccgtcggtggcggtcgtgaatcagtggcagaatgcggtcaatgcaggatcgggcaacacgtttattgcgtcactgcagccgcagcacccgcagtatcagccgatgcacgccgcgctgaaaaccctgctaggtgataaacaaccctggccgcagctgaaaagcagtgaaacgctgcgcccgggacaggtcagtgacgatgtgccggcgctgcgtgaaatcctgcagcgcagcggcatgttaacggcgcaggttaatgcacctgcaccggatgacgatgcggtgccggtggccgcctcaccagtgacccacagcgaccagccggttgcggtcagcccttccgccgcgccagtcaccgatctgtccgcgccttcactgcattcgccgggtaacgttcagagtcagacgctggaagggaataccgccaatgtctatgacgagacgctggtggcgggtgtgaagcgtttccagcagtggcagggactggatggcgacggtgctatcggtgccagaaacgcggcagtggcttaacgtctctccgcagatgcgtgcttcgttgctggcgctgaacattcagcgactgcgcctgctgccggacgatatgcacaacggcattatggtgaacatcgccaactactcgctgatttattacaacaacggcaacaagatcctctcatcacgcgtcatcgtcgggcgtcccgatcgcaaaacgccgttgatgcgcagcgcactcaataatgtggtgctgaacccgccatggaatgtgccgaccacgctggtgcgtaaagatatcattcctaaagtgaagcaggatccgacctatctctataagcatggctataccctgctgtcgggctggagcgctgacgctgaagtgatcgatcccagcatgatcgactggcgcatggtcaccgcttcatctttcccctatcggttgattcaggcaccgggtgtggcgaatgcgctgggccgctataaatttaatatgcccagctcagatgcgatctatctgcacgacacgccgaaccacaacctgttccagcgggatatccgcgcgctcagctcaggctgcgtccgggtaaataaagcgtccgaactggcgggcttattactgcaggacgcgggctggagcgatgcccgcatctccagtacgttaaaagagggtgacacccgctacgtgcccattcggcatcgtattccggtcaatctctattatctgacggcgtgggtcgctgatgatggcaaaccacagttccgcacagatatttacaattatgatgacaccgcgcgttcgggcagccaggctttgagtcgggctgagcaattgctgctctagtgattgattttaaatcgttagcggcgggccggttattcagaaaaatgttatcaaatggcgattcctgcagggatcgccacgcaaacaggttgcagatgggttgacgctctactgagagaaagttatggttcgggctgtgcgctttttgcacatttctatggcttcactctcaggtaaatcgttacatgtctactattgattcttttcgtcgcaaactactgctgtgcggtagcgccgccgccggtctggcattattacccgcttctgcaagggcctcgctttctacctctcgcccgcgtgtattgatgcttaataatcttcataccggtgaaacccttaaaactgagttttttaatggtaagagttacgacaaggatgagttgtcacgattaaatcactttttccgtgactatcgcgccaataaagtgaaaagcatcgatccgcacctgtttgatcaaatcttccgcctgcaggcgctgctgggaatgcgtaaaccgatacagctggtttcgggctaccgtttcactggcaaccaacaacatgttacgtgagagtggtcctggggtggcaaagcacagctatcacaccaaaggccaggcaatggatttccatatcgaaggagtttctctggctaatgtacgcaaagcggcgttatctctgcgtgcgggtggtgtaggatattatccccgcagtaactttgtacatattgataccgggccgatcaggcactggtaatgacaccggcaacgctgcgtgagccggtcatggagcgttatgaattaccacattattcctgttaccgcgtttgcccagaactgttcagttatctggtgcgagtccactcgtgaagccgcgctggttgatccaggcggcgatgccgatctgatcaaagagacgctggaacaacgccagcttaaaccttcccggattctgctgacccatgggcaccttgatcacgtcggggctgccgtcgagctggctgccttctggcagattccgattgtcggaccacaaaagcgtgatgcattctggctggaggcgctgcctacccagagccggatgttcggacttgatgagtgcgcgccttttacccccgatcgctggctggaagagggggagagcgtacaggtagggctgaccacgctggaagtcctgcactgtccgggccattcgcctggccacgtggtgttcttcgatcggccaggaaggttactgatttcaggtgacgtgatttttaatggtggtgtgggacgcacagacttcccgcagggcgatcatcaacagttaatcgatgctatccgcacgaaactgctgccgctgggcgatgatgtcacttttctgcccggtcacggcccgatttctacgctggggcatgaacgcatcagcaatcctttcctgcaataaaaaatgggccagcaggcccatttttcaattcggtcatcctgcttacagcacggcgacaatggcttcgcacagcgccgacatattgtctggcgtcatgcccgccacattcacacgccctgagttcaccgcgtagacgccaaactcttcacgcaggcgaatgacctggtctttggttaagccactgaacgagaacatgccgttctgcttaataataaagctgaagtcgcgctgtgcgcctttctccgccagcgtgtttacgaagagctggcgcatgcgctgaatgcgctgacgcatgtccgacagctcctgctcccagatggtacgcagggtatcgttgcccagaatggtggcgacgatggcggcgccatgtgccggcggattggagtagttcgcgcgaatggtgtacttcacctgactgaaacgcggtatcagccacgctcgcatcggcggcaaccagcgtgatggcaccgacacgctcgttatacaggccgaaattcttggagtaagagctggcgacgatcagttcctgatgcgaggcggcaaaaatacgcaggccttctgcatcttcctccagaccacgggcaaaaccctggtaagcgaagtcgaacaatggcagccagccattggcctgtgacagctgcgccagctgttgccactgctcagcggtcgggtcgataccggtcgggttatggcagcagccgtggaacagcaccacgtcgcctggctgaacctgttttagcgacgccaccatgccatcgaaatccagcgtatggtttgcagcgtcataatagtggtattcacagacctcaagaccggcagcgttaaacacgttgttgtgattcggccagcttggattgctgatccagacccgcttcaccgatgtttgcgtggcgaggaaatcggctgcaacgcgtagcgcaccggtaccacccggtgtctgagccgtgcgagcgcggccagcggtgattagcgggctctggttgccaaacagcagggcctgtgtgcagcgggcaaaatcagctaggccatcaatgctgagatagtttttggtggtttcattttccagcagatattgctcagcttttttaacactggtcagcaccggggtcttgccggtttcgtctttatagacgccgatacccagattgattttttccgggcggtcgtcagcacgaaacagatcggccagcccaagaataggatcggcgggtgcagcagagatcgattcaaacatgtgtcaggtccattagcgtgaactttagcgaaaagagctctcaggttagcgtccggccagtcaaatgccaaccgtttgcgagacaaattcatacattttgtagtgtggattgcgcgacggggaaatgcagacgtttaagcggagtagaagggcgtgagaaaacagagttctggtgaatagcagccataaaaaaacggggccttagccccgtttttcaacatgttttaagcagtattagaactggtaaaccaggccaactgctacagtgtcatcagtgttcagattcagacggttgttgtcatccagctggttgatctgatagtccacataggtagacatgtttttgttgaagtagtaggtcgcgccgatatcaatatatttgatcaggtcagcatcgcccacaccttcgatatccttgcctttagactgaacataagcaatggatgggcgcaggccgaagtcgaactgatactgtgctaccagctcaatgttctgtgctttgtttgcaaagccagtggtagagaacgcgttaccgttagccagagtaccggtagcagtaactggtgttgagttgcgagtttcaccgtacattgcagccaggtaaacgttgtttgcatcgtacttaatagccgttgcccagttttcagcgcgtttaccagcaccctgaccggtgacattggtaactgcagcaccgccgccattagcctggctaggtgtaacagttgtctgtgcgcctgctgcctgagcattagtacgatcgctgctgctataagcacctacgatacccagaccgattggtgaggtataagaggttgacacaccgtagccgtcgccgttggagcgacgcaggccgtcggtaccggtgcgctcgtttttaccctgatactgaactgcgaagtcccagccatcaaccaggccgaagaagttggtgttgcggtaggtcagcaggccggtgctacggccgttcatgaagttatcggaatatcctgaatcaccaccgaaactctggcagcatatcggtccagccgattgcatcataaaccacaccgtagttacggccgtagtcgattgagccagcatcgccgaatttcagaccggcaaagcccagacgggttttgttgccattctgtgcatcagaaccttcagagttgttcgcctgaacgttgtattcccactggccgtaaccggtcagctggtcgttaatctgagtttcacccttgaagccgaagcgaacgtaagtattgtcgccatcgttgccgtcgttatcagagaagtaatgcaggccaacagctttaccgtacaggtccagtttgttgccgtctttgttatagatttctgcagcgtttgctgcgccggcggctaacagagcagggataaccactgcaagaatattgcgcttcatcattattcattaccctcattggagttatttgtacacctgccactgccgtcaagaaacctttacgggaaccctgaacgaagtttggtgtcttcctgtgtctgcacgcatctttccatcccacccgccgtaattctagcgcttaaatgctactaaactcgcaatcttgtttcattaagaaaatatgtattacaaaatgtaaaaaacacggaactttgtgagagaactcaaaatttacaaaaataaaaaaaggccggcagtgccgacctcgttatatatatgaatttcttatatttaatgccgaatatcagaaactcgcgttgcgtggggtgcgcgggaaggggattacgtccctgacattttgtacgccggtgacataggcgattaaacgttcaaagcctaatccaaagccagaatgtggcacggtaccgtagcgacgcaggtcacgataccaccagtaatcttctttattcagacccatctcttccagacgcgcatccaggacatccagacgttcttcacgctgtgaaccgccaatgatctcaccaatgcctggcgccagaacatccatcgccgccacggttttgccatcgtcattcaggcgcatatagaacgctttaatgtctttcggatagtttttcaccaccaccggcgctttaaagtgtttctcggccaggtaacgctcatgttcagaggagaggtcaataccccaggaaaccgggttttcgaaggtctgaccgcagttcatcaggatctcaaccgcatcggtgtaatccacctgcgcgaaatcggtggtgatgaaacgctgcaggcgctcaaccgcctctttatctacccgctcagcaaagaaggccatgtcatcggcacgctcttccagcaccgcgttgaagacatacttcagcattgattcggccagtgcagcggcatcatccagtgaggcaaaggcgatttccggctccagcatccagaattccgccagatggcggctggtgttggagtttctctgcgcggaacgtcggaccgaaggtgtagatcttcgacagggcgctggcataggtttcgccattcagctgacctgaaacggtcaggaacgcctctttaccaaagaaatcttcactgaagtcaactttgccctgatcgttacgcggcaggttttccatatccagcgtagagacacggaacatttcgccggcaccttcggtatcggaggcggtaatcagcggcgtcgagacccagaaatagccattttcatggaagaagcgatgcagcgcctgcgccagggtgtggcgaacgcgggcgaccgcgccaatcaggttggtgcgcggacgcaggtgagccacttcgcgcagatactcgatactgtggcgtttcgccgccatcggatagctgtcgggatcttccacccagcccacgacttccaggctggtcgcctgaatctcaaacgcctggccctgacccggcgaggccaccactttaccggtgacgataacggaacagcccgtagtcagacgcagcacttcatcctgataattattcagagaattattgacgacagcctgaacgggattaaagcaggagccgtcatagacagcgatgaaggaaagaccggctttggaatctcttcgggtacgcacccaaccacgtacggtgacttcactgtcaaccgcgacgcgaccgtgcagtacgtccgctacaggcactacgctcataaatatctctctatatagaagaagtgagtaaaaaagttgccccatccggggttttgctatgttacttgcgagtcttcaggaaacaagcaaaattcagggggaaagcagatttattacagcagaggcggggcgtatcaacgccccgataagaagaggattaactcgcttttttcaccagcggcagatcaaaagctttacgcagggctctgacaaaggctttatcctggcagatagttttgcccgggctgtctgagagtttcgccaccggcttgccattgcactgcaccagtttgataacgatattcagtggcgtcacgcccggaatatcgcaggtgaggcgggttccgatgccgaacaccacgttcgtccgctgaccaaagtggcggtaaagcgccagcgctttgtcgagatttaagttgtcagaaaagaccaggtgtttgctttgcggatcgatacccagcttctggtagtgggcgagggctttctcgccccattcgaccggatcgccggagtcgtggcgcagtccctgatagcggcgggcaaacaccgggccgaaatcgcgcaggaatgcgtccatggcgatgcaatcggtcagggcgatgcccagcttatcgtcatactcatccagccacgcctgtaacgccgcgcgctggctgttggccagtaccggactgatctgctggaaggcctggaaccactcatgcgcctgtgttcccaccggcgtcagtgacaaacggcgcgccagatcatagttactggtgccaatcagccacggaaattcctgtttcagcgttgagacgatcgactgctgcacatcctgcgaatagcgacgacgggtgccgaaatccatcaggcggaagcgtgacatatcaaggtcagccacctgggctttaaagtcgccgagtttctgatgtaaatggtcaagtgcctgctgagtggtgacctgtggcgtgcgatgacgatgcacaatctcactgatcagcgccagcagcggcacctcccacatgatcacttcgcgccacggcccctgaatacggagttccagcttgccatggtgattgcgcacctcaacctgatccgggttatagcggaactggcgtaaccagctgaggtaatcctgccggaagaagggaaggtgagacaaccaggtcgcttcatcatcagtcagcgccaggtgttgcattgcggttatcgcgtcacgaatttcgtcagcgtagagacccagcagtttcgtcgccgcggcagcgaaactccgccgccaccgttatgtcatgatagcggtggaaaacggcctgctgcatatggagcttataggcgtccgtatccagcagcgaggtcagtatcggggaagcatgtcctgtcatggcgcgtttcagcatcctgttcggtggcgcagagcccggtgttgtacacagtcataaagacgcaaaagtataattcactatctgaagccgatcacagcatatttcagacgggcgggtcgaggccaatctgtgccattgttaacaaagtgtagccatttcaccctttaggtgcattgtgcgtggcaagcttgtagtaacaagcttagactttgccggtaaacttataacaacgcgagacgcaatatgacgcaacagccccaaatcaagtatcgccacgactaccgtgcgcctgagtacaccatcaccgatatcgatttaacttttgaactggatgcgtccaccacccgcgtaacggccatcagccaggttaaacggctgggcgacagccaggctgagctgcgactggacggcgaagcgttaacgctgattgcgctggaggttgacgggcaagcctggacggccttccgtgaagaagagggcgcactggtcatcagccagctgccggaaagcttcaccctgaaaattattaacgatattcacccggaccagaacaccgcgctggaagggctgtacaaatcgggcgaggcgctctgcacccaatgtgaggctgaaggcttccgtcatattacctggtatctcgatcgccccgacgtgctggcgcgctttaccaccaccatttatgccgacggtgagcgttatccattcctgctctccaacggtaaccgcattgacagcggccgggatgagcagggtcgcagctgggtgaagtggcaggatccgttcccgaaaccctgctacctgtttgcgctggtggcgggcgatttcgacgtgctgcgcgacagcttcaccacccgttcaggacgtgatgtggcgctggagatcttcgtcgatcgcggtaacctcgaccgtgccgactgggcgatgacgtcgctgaaaaacagcatgaagtgggatgaagagcgtttcggtctggagtatgacctcgacatctttatgatcgtggcggtggacttcttcaacatgggcgccatggagaacaaaggccttaacgtcttcaatgccaaatatgtgctggctaaagcggaaacggcgacggacaaagattacctgggcattgaagcagttatcggtcacgaatatttccataactggaccggtaaccgcgtgacctgccgcgactggttccagctcagcctgaaagagggactgacagtgttccgcgatcaggagttcagctctgatctgggctcacgcgcggtgaaccgcattgataacgtgcgtatcgtacgcggtgcgcagttcgccgaagatgccagcccgatggcacacccgatccgtccggatcaggtcattgagatgaacaacttctataccctgacggtgtatgaaaaagggtcagaagtgatccgtatgatgcacaccctgctgggtgaagagaatttccagaagggcatgaagctctattttgatcgccacgacggcagcgccgccacctgtgatgattttgttcaggcgatggaagatgcctcgaatgttgacctgtcgcagttccgccgctggtacagccagtccggtacgccagtgctgacggtacgcgacgattacaacccggagctggagcagtatacgctgcacgtcacgcagcacacgcctgcgactgccgatcagaaagagaagctgccgctgcatatcccgctggatattgaactctacgatggcgaaggcaaggtgatcccgctgcagaataatggtcatccggtacatcatgtgctgaatgtcaccgaggagttccagacctttattttcgataatgtctacttccagccagtgccgtcgctgctgcgcgaattctctgctccggtgaagcttgattacaaatggagtgatgctcagctcaccttcctgatgcgtcatgcacgcaacgacttctcccgctgggatgcggctcagagcctgctggcgacctatatccgtctgaatgtcgcccgctatcagcagggccagcatctgtcactgccgctgcatgtcgccgacgccttccgcgcggtgctgctggataccgactgcgacccggcactgaccgcgctgattctgacgctgccgtcggaaaatgagattgccgagctgtttgatactatcgatccgcaggcgattgcgctggtgcgtgacgcgctgcaacgcacgctggcacgcgaaactggccgatgagttctttgcgatctacaacgccaatcagcagcctgaataccgcgtggagcatgacgcgataggtcagcgcagtctgaaaaatatctgcctgacctatcttgcattcagcgatgcgcagctggcggataaactggtgcagacgcagtatcaccaggcgaccaacatgaccgatgcgctggcagcgctttctgctgcggttgcggcacagttaccgtgccgtgatgcgctgctggcagcttacgatgagcgctggcatcaggatggtctggtgatggataaatggtttgtgctgcaggcgaccagtccggccgctaacgtgatgcgcaatgtgcgtcagcttctgaatcatcgctccttcaccatgagtaatccgaaccgcgttcgctcgctggtgggtgcctttgcctcggctaaccctgccgccttccatgctaaagatggcagcgggtacaagttcctggtggagatgcttaccgaccttaacacccgcaatccgcaggttgcggcacggatggtggagccgctgattcgcctgaaacgttatgacgaagtccgtcaggcgatgatgcgccaggcactggagcagctgctggagctggataaactctctggcgacctctacgagaaaattacccgggcactgaacgcctgataataaaaaaggggagtgtctgagacactcccctttttcagcgctgctgcgcgaaacgaaccggctgcggtcgctccgtacgctgcatgacccgatccagtacctccgcttccagctcggccagccgcgccgatccgcggcggcggggacggggcagatccaccagcagatccagcccgatttgaccctcttcgatcaacagcacgcgatctgccatcaccaccgcttcactgacatcatgcgtaaccagcagcacggtaaagtgatgctgctgccacagtgactcaatcaatccctgcatttcaatgcgggtcagggcatccagcgcccccagcggttcatccagcagcagtaaaccgggccggtggatcagcgctctggccagtgcgacgcgctgtttctggccgccggagagggcggctggccactcatcagcccgatcggcgaggcctaccgccgccagcgcatccagcgccgcgctgcgccattcgcgtccgcgcagacccagtccgacgttatcgatcacttttttccacggcagcagtcgcgcatcctgaaacatcaggcgggtatcttcacgagccgactgcagcggcgcattgcctgccagcagttcaccgctggagctctgttcgagaccggccagcaggcgcagcagcgtgcttttgccacagccgctgcgacccaccaccgccacaaactgaccggagggaatatgcaggtcaatcttattcagaatggtgcggctgccatactgtttgctgacgccgttaacgccaaccggggtgccggtgttaaggcgcgccggtgagagagtctgactcatgcgttctcctccttcagttgataagcgggatgccagcgcagccagacacgttcaagtaacaacgcggcgacatctgccagtttgccgagcagggcgtaaagaataatggcgaccactaccacgtcggtctgcaggaattcacgcgcgttcatggccagatagccgatacccgcgttggcagagatggtctctgcgacaatcagcgtcagccacatcagacccagcgcgaaacgcacgccgaccataatattgggcagcgcgccgggcaggatcacctggataaacaggctccagccggaaaggccatagctgcgcgccatctcaaccagcccgcgatcgatgttgcggatgccgtgataagtattcaggtagatcgggaacagcgtccccagcgccaccagaaagatcttggcggactcatcaataccgaaccagaggattaccagcgggatcagcgccagatgcggcacattgcgcagcatctgtaccgaggtatccagcagtcgttcaccggttctggaggtgccggtaatcagcccgagcagcaggccgatagaaccgccgatactgaagccgatcagcgcccgccagctactgatcgccaggtgttgccagagctcaccactggcggtcagctgccagaaggtggttacaattttctccggtgcgggcagaatgcgggtcgacaaccagccggtttgcgaggcaatctgccacaccaccaccagcagcgtcggcagcagccagggcaccagcgtatcagcaaggcgttttcgggttctggtcatcatgctctcctcagccccgggcgacttttttctcaggggtaaaatcgttggctaccgcttcaccgtgtgcctgaaccacgcgtggctggggcaccagtggaatctgcagatcaagatgcgggaacagcagttcgccaacgcgatacgcctcttccaggtgcggataacccgacaggataaaagtctcgatgcccagcgcttcatactctttgatgcgagcggccacggtcgggccatcgccgaccagcgcggtcccggctccgctgcgcaccaggccgacgcctgcccacaggttagggctgatttcgagcttgtcgcggcgaccgccatgcagtgcggccatccggcgctgccccacagaatctgcccgctggaacgccgcctgcgctttcgcgatggtggcgtcatccacattggcaatcagtttgtctgcggcctgccaggcctcttcattggtttcacgcacgatcacatgcagacggatgccaaaccggacggtgcgtccctgggctgccgctttcgcgcgcacctgatcaatcttatctttaacctgcgcagggggttcgccccaggtgaggtaaacatcgacctgttcggccgccagctcctgggctggctcagaagagccaccaaaccacagcgggggacgaggctgctgcaccggtttaaacatcagacgcgcaccgcgtaccttcacgtgcttgccttcataatcgacggtttcgccttccagcacccgacgccagacgcgggtaaactcggcggattccgcgtagcgctcgcggtgatcgagaaacacgccgtcgcccgccagctcttccggatcgccaccggtcaccagattaaacagcgcacgtccgttagaaagacggtccagcgtggcggcctgacgtgctgcctgggtcggtgaaatcaccccaggacgcagtgcgaccagaaaccgcaggcgctgcgtcaccggaatcagcgaggcggcaaccagccaggcatcttcacaggagcggccggtcgggatcagtacgccgccaaagccaaggcggtcagcggcctgcgccacctgttgcagataggcgtgatcaaccggtcgcgccccttcggcagtaccaagatagtggccgtcgccatgcgtcggcaggaaccagaaaatggatacgctcattgttgctccttattgcgtcacggtatgcggatgccagatgcgatcctggatcgtcacttttactggcaagagatgattggcatagaacaggtcagcagtgcgctgctgagctgcggcagtttcggcactgaccggcgaaatccgggtgggtggccgatggctgaggtagctggcgataaccggttcgggcaagcccatcgcctgtgccagtaacgtggtgctctgctgacgctggctgattgtcagcgcgtcagcagagctgaaggtgtcgagcacctgctgaataaacgcgccatgggcttcggcatagctgcgggtcgctaaatagaaggagccggtaagattaagggagctgccatcaatcagcaggcgcgaatttccctgcagcagcaccgatgaatagtaggggtcccagattgcccaggcatcaacgtcaccctgctggaaggcggcacgcgcatcggcgggagtgagataaaccggcgtgatgtctttaaaggtcagacccgcctgctgtaaggcgcgcagcagtaagttgtgagagctggagcctttctggaaagccactttcttgcctttcagatccgcaacctgtttcagtgggctgctttttggcaccagaatcacttctgctttgggttttggcggctccgcgccaacatagagcagatccgcgcccgcggcctgggcaaacagcgggggaagatcaccggtactgcccaggtcgatactgttgatattcagcgcttccagcatttgcggacctgcagggaactcgatccacttaatccgggtatgaggaaatcgtttttccagtaactgatgtgactttgccagcaccatgctgaccgaacctttctgatagccgatacgaatctcagacggatcggattcggcggcctgtacctgaaggccggccagcagaagtccggccaccagccactttcctaatctcagcttcatcgatcgcttccttataccgcttgcgcaacgggatggtggtgacgggtcagtgccagccagaaggcggagacggcctcatccaggcgctgtgacagtgaatcctgcagtttcgggctgacggtcgtaatgactgatctgatgatcctcggcataaacaccatgcaggatctcctgcgcctttaaggcgttgagcaccggcttcagggcgtagtccagcgccagcatatgaccggcactgccgccgctggccagcggtaacacgactttgtgttccagtgcgcgttcaggcagcagatcgagcagcgtcttcagcgcacccgaaaacgacgctttatagataggtgtcgcaataatcagtccatcagccgaagccagatcgtcacgcagggcgagaagcgcaggtgcatcaaaacgcgcattgattaaatcgtcaggctgaaagttgtgaatattccacggaatgacttcaataccacgcgcctccagcttgtgctgacacagcgtcagcagtgaggttgagcgggaggggaatcgtgggctgcctgccagcgtaataactcgcatcatcactccttataactaaaagttattgattatcaaatgttgagaacttatgccttcatactgtcagagcaggggagtgggcttaaatgatttatccggcaaagtaagggtgaaatctgcaaatagaaggcgttgcgacagatgtcagcatcgccgcttccgataattcttaaattaagcgctgacagcggaacaattcattaaggggcatgatacgagatcgtcaaaatgtgtcggttgagcagaaaaaatatctttcgtctgattgcttaatcattttttctgagagtggcgcggccataaagcgcaacggctgaaaaaatagcgctgcgaagcagcacagaatcagcttatctgcggcagcctctgccaaagattaagatttattgcagaaagcaaactgtaataataatgaaggaatgctgaacttattcatcgtttcagatgttcgcttacagatttctgaatctggttacgtctgctttgcagggctaatttaaatcgatcctcaacggttttaacattactgcgggctatagatgcactttcgttaagagtgatgctcacatgaaacattaagatgatttttacggctggtcttttttcgcattacaggtttaagataatcgggctcaatgaaagcaatcataataatcgcgccttactcttttcgacgtttcgcctctggtcagaacctgcatcaggcaggtgaatcgtattgtcattttctaacagcagagaattgcatatgtctgacatcctgttatccgttattattccaacctataatgttgagaaatatattgtagagtgcgtcgattcgttattacgccaggttaaagcgcccaatgaaataatcattgtgaatgatggatctactgatggaacattagccttaattgaacagaattatgcacacctttctcaggtgaaagtgatcaccattgaaaatggcggcctcggcaatgcacgggacaccggcattgcactggcaaagggtcagtttctctttttctgtgatccggatgatgtcgtggttgatggcctcgtcactgagctggcaatggtggcggagaagcatcctgaaacggatcttttctgttttaactcctgcgtctatgaagatggccacattgatatcacctcgccaaaagtgaagcatgaccagtttggccagcagaaaccacaggaggtctttctgcgcctgctgcgtaatggcagatatacctctgccgtctggaattacgtcttaagaaaaagcgtcattgaacagcataagttgcgctttgtacgtcgggttcatgaagaccacaactttacgctctccgtgtttatgaaatgccagcacgcatgggtcagccgtcaggtctattataagcagcgcatccgcagtggttcactgaccaacagtaccaaaggcaatgagtttttctatcagcgctatgacgcttttatgcatgcttataatacgttaaccagttcgctccctaaatcagcctggcgtagttcgctggaaaaatcttatttacttcactcgttccgtctgatgatctatttgtctctctataataaaacgccggtaccagaatatgttcttaatgctattcgctttatgggacgcaacgtaaaaactgagaacattaaagagtggctattgttcaatcggcctgaactgtttattgcactgcagcattataaggtcaaaaaagaactcaggcgcgcagcctgattctgaaaaacagcctgattctgaaaaatgtttagcgatattgtttatgccttagcgaaatgagaaggtgagacatgcaatgtgtataaggttgttgcgacatggcaaaagtactcgataaaagtctggttattaatattttctcgctgctggcttaccgtggcgcgtcgtttctgtttccgctggccacgctgccctatcttgcccgcgtttctgggtgtagagcaaatgggtacgctggcgctggcgatcgcctgcgtcctctattgcagcaccatctccgactggggattcaatgtctttaccaccaaagatattgctcaccatcgtgatgacaaagaacgcgtcagccagctcttctggtcaacattcaacgccaagctgatgctgctggtggtcaccagcggcacgctgctgactgcgacctggttcaatccctcctggcaccctctgttcttcatcattctggcgaactgcaccacgctggtcggctcgctgttttcattcggctggctgatgcagggctttgagaagctgggtaagacggcgatgatcgccaccttcggtaacttctgtgcgattccgctgacctttttgctggtgaaatctccgcaggacacctggctggctgccctgatccctggcgcggtctccattatcagcgcggcgattacgcttaagttcgtgctggagatgaaagtcattggccgctatcgctttgaaccgcgcgaaatcaaacagcgcatcaccgacagcatggatgtatttatcgccattgccggcgctaaccttttcaacagcgtcaacgtggtgattctcgccacctttgcttctacttacatggtcgggatctacaacggcgccgatcgcctgcgtaaagcggccaactctgtgccggagcagatcggcagcgccttcttcccgcgcgtcagccacctgttcggccgggataaacgggccgcgattgccgcgacacgcaaaagcctgctgctgtcgttttccctgagtctgtcgattgtaatcttcacctggttctttgctgacctggtggtctcaatattgctgggtaaagactttatccagtcagcggatgtgctgcgcgtctttgtgctctgcttcctgtttggcaacattgcctacccggctggattacagattctgatcccacatggtctggcccgccagcgtatgtgggtgatgatggccgctggtgtggttaacgtgccgctctgctgtttcctggcgtggaagtttggcgcaatcggtgccgcatggtcgatggtcggggctgaagcgttcgtctgtctcggtatttttggcatcatgcaacgtcacggcatcctgcgggaatatctgtttccctctgaggtgaaaaatcaaaccgtaaacgattccgccgcgtaagatcaaagcattttcagatagttttatgcatccccgctgttcgatttacttttgcgccagagcactttaccattctggcgcacattttcccgtgcaccgacttccacgatcgcttccgtccttcaggagagtgcatgttttatcctatcgtccgaccggcgctgtttaaacttgatcccgaacgcgcacacgaactcacttttcagcaactgcgttttatgaacggcaccccactggagatgttttatcgccagaatctgccgtcgcgtccggtcacctgtatgggactgacctttaagaatgccctgggcctggcggcgggtctggataagaacgcagagtgcattgatgcgtttgcggcgatgggctttggctttgttgaagtcggcaccgtcacgccgcgcgcccaggcggggaacgataagccacgcatgtttcgtctggtggaagcgggcggaattatcaatcggatggggtttaataatctgggtgttgatcacctggttgaaaacgtgaagaaagcgcgctttaacggcgtgctggggatcaatatcggtaaaaataaagatacgccggtcgagcagggcaaagatgattatctgatctgcatggaaaaggtttatgcccacgccggttatatcgccatcaatatttcctcacctaacactcctggtttacgttcgctgcaatatggtgaggcgctggatgatctgctttcttccatcaaacagaaacaaaaagagctggaacagcgtcatctgaaatatgttccgctggccgtaaaaattgcgcccgatctctctgaagaagagttaattcaggtcgcggacagtttaattcgtcatcagattgatggcgtgattgccagcaataccacgctcgatcgttcgctggtgagcggtcttaagcatgctgaagaagcgggtgggttaagtggacggccagtgcagtcgcgcagcacggcggtgatccagcgcctctctcaggaactgcagggacggttgccgattattggcgtcggcgggatcgattctctgacggcagcgcgtgaaaaaatcgccgccggggcaacactggttcagatttattcaggctttatttatcaggggccaggcttaattaaagatatcgtcacccatctctaagacaattctcacaatcattggccggggggtttatttatcccctcggctcgtttatattttgtcctgttgcacgctttttcagcttttccttatgtttcttttttcgctgaattctgcgtgatttttggcgcagcggtaaatacagggcacacgatgaaaattaaacccgatgataactggcgttggtattttgacagtagccacgaccgaatgatgctcgacctggcagacggtatgctttttcgttcccgttattcccgcaaaatgctcacgccggatgccttcactgaatcgggtttttgtgtcgatgacgccgccctttattacacctttgaagagacctgccgtcagtgcaaactcagtggcagccatcgcgctgaactggtgttaaatgcgctggtcgctgcacgtttcctcaagccactgatgccgaaaagctggcatttcgcctcttatgctccggcaatgcagccccgtcccggtgaaatggtacaggttacgctggcagaagagggaacgcaggcacgactgctggtggttgagagtggcgataatgcggcgctctgcctgctggcgcagccgggattgacgctggccggaaaaaacatggtgctcggcgatgccatcaaggtgatgaacgatcgcctgcagcccctgtatcaggatgtcgcgccgcgctacgcccgcgcagtctgactaccttagttctacatcgccagccggaatacagctgcagctcaacagcgtgccgtcctgacgcagggcgctctgtttcagcgccttaacctcacccgcgaccagactcagcttgcaactgccgcacagtcccgcccgacaggagtaggggatccggaagccctgcatctccagctgatccagtaatacctgctgattatccccggtgaacgtctgaccctgaaacgtgatagccacggcatctggcgcctgctgctttggtttcagtgtttcgaccacttcaccggcaccatagctgcgcggtgcatgacgtttcaggacaatcatctcatcaccggcgcgcaccaccccactgttgcgcgccactaagttcagaccgaaatcaatatccccgctgccatccagggcggtgcggaacgtctgcagcgtggccagtggatgaccggcaggatgcttaacgccggtctcggtgctgacagtggtgagcacgcagcgactgcatggcttaggcacctcgaatatcacgtcgccaatctgaatctccgcccagctgtcttcatcccatgcggcagcgccgctgacgaccagattcggacgaaactgttcggcacggacgctggccgggcagcgctgttgcagatcatgcagcgacgcgttgttgatcagcaaaaacggaaagccgtcggcaaagctcagcggaatatgattaaacgctttaacccggcggctgagttgcggcccgacccagcgcaactgaacctcacgcgggaagaactggctcagccattggttaatcgcaggcggcgctatgcgcgcggtgaaatgatttccccagacttcggtggggtgatcctgctcatcgaaatcgctgaagcggatcagggagtgactgccatccggggccgtcagcagcaggccatccggtaaaatcgcgggcgtgaagcgcaccatctccggatgctgacgcgcggtaataaaggtgccatcaggttcggtcaccataaacagacgatcaaatgccagtccgctgtcagtgaccagcgcgtgtgacagcgctaatccccgcatcgacttcacaggatgaataaataagcgggaaagcgtgatcatggtgttctccttgaacccgacgcgcagcacaaaagaagctaactttatgacataggtctccgattcgctataatgcgcgacaattttctcaagagttaaaaagtgacgatatgaattctctgtttgccagcacggcgcgtgggctcgaagagctgttaaaaagtgagctggacgcgctgggcgcgcaggatttgcaagtggtgcagggaggcgttcactacgaagccgacgatcgcaccatgtaccaaagcctgatgtggagtcgtttagcatcacgcatcctgttgccgctgggagagtttggcgtctacagcgatctggatctctatctgggcgtgcagagcgtggactggccgacgatgttcggcagtgacaaaacctttgttgtgcatttcagcggcaccaacgattcgattcgtaacagccagtttggtgcgctgaaagttaaagatgccatcgtggacagctttacccgtcagaatctcgaacgacctaacgtcgatcgtgaacaggcagatatccgtgtcaacgtctggctgaatgacgatcgcgccagcattgcgctggatctcagcggcagctcactgcatcagcgtggttatcgccagcagaccggtcaggcgccgttaaaagagaccctggcggcggccatcgtgctgcgtttctggctgggagccgacgacaccgctgatcgatccgatgtgtggttccggtacgctgctgattgaagccgcactgattgcctgcgatcgtgcgccaggcctgctgcgcaagcactggggcttcaccgcctggagccagtttaacgctgcgttgtggcaggacgttaaaaccgaggcgcagaaccgtgcccgcactggcacggctgccacccaggcgcgcttctttggctacgacaataatggtcgggtgctggagtgggcgcaggcgaatgcccgccgtgctggcgtctttgaacttttcaccttcggccagcaggatctgctgaagctgactaatccggttgacccggcggttcacggtacggtgctgagtaatcctccttacggtgaacgtctggagagcgaaccagccctgattgcgctgcacagccagctcggacgtctgatgaagcagcattttggcggctggaacctgtcgctgttcagtgcctcgccagaactgctgagctgcctgcagctgcgtgccgatcgccagtttaaagcgaagaacggtccgctggattgcgtgcagaaaaactataagctggcggttaacagtcatgaaagcgccggacagattgcggaagattacgctaaccgcctgcgtaaaaacgtgaagaaactggagaagtgggcgcgtcaggaaggcattgaatgctaccgtatttatgatgccgatctgccagactacaacgttgctgtcgatcgctatggcgactgggtgattatccaggagtacgcgccaccgaaaaccatcgatcctgataaagcgcgtcagcgtctgttcgatgtcatcagcgcaacgctgagcgtgctgcaactgcctgccgaccgtctgattatgaaaacgcgtgaacgccagaaaggcaaagcgcagtatcagaagctcagcgagaagggcgactatttcgaagttaaagagtttaatgcgcgtttctgggtgaatctgaccgactatctcgataccggcctgttcctcgatcaccgcattgcccgtaaaatgctgggccagatgagtcagggcaaagatttcctgaacctgtttgcctataccggtaccgccagtgtgcatgccggtctgggtggcgcgcgttcaaccactacggtagatatgtcgcgtacctatctggagtgggcggagcgcaacctgcgtctcaacggactgaccgggcgtcagcatcgtctgatgcaggcggactgcctgagctggctgaatgagagtgacgagaactttgacctgatctttatcgatccgccaacgttctccaactcaaaacgtatggaagagagcttcgacgttcagcgcgatcatatgatgctgatgcgtaacctgaagcgcctgctgcgtcgcggcggcaccatcatgttctccaataacaaacgcggtttcaaaatggacatggatggcctgaaatcactgggcctgcaggcgcaggatattacccagaaaacgcagtcgcaggacttcgcgcgtaaccgtcaaattcacaactgctggctgatcactcacgccggtaaggaataagcttacatgtcattaatcagtatccacggcgcttatctctccttcagcgatgcgccgctgttagacaacaccgaaactgcacatcgaagagaacgaacgcgtctgtctggtgggccgtaacggtgcgggtaaatccacgctgatgaaaatcatcaatggcgaacagccactggatgatggccgcattatttatgaaaccgatctggtcgtggcgcgtctgcaacaggatccgccgcgcaatattaccggttcggtgtatgacttcgtggccgagggcgttgaagagcaggctgagcatctgaaagcctatcacgccatttcccatgtggtgatggaagaccccagcgataaaaacctcaatgagatggcgcgtctgcagagcattctcgaccaccagaatctgtggcagctggagagccgcatccatgacgtgctggagcagattggtctgcagcccgataccgagctgtcgtcgctctcgggcggctggctgcgtaaagcggcgctgggccgtgcgctggtgagtaacccgcgcgtcctgatgctggatgagccaaccaaccacctcgatatcgaaaccatcgactggctggaaacgttcctgaagaacttctccggcagcatcatctttatttcccatgaccgttcgtttatccgcaacatggcgacgcgcattgtcgatctggaccgtggcaagctggtctcctggccaggcaactacgatctctatctggaaggcaaagaggaagcgttgcgcgttgaagagatgcagaacgcggaatttgaccgtaagctggcgcaggaagaggtgtggatccgtcagggcatcaaagcccgtcgtacccgtaatgaaggtcgtgtgcgtgcgctcaaagcgctgcgtcgtgaacattcagaacgtcgtgaagtgatgggcaaagccaacatgcaggtgggcgaagcgtcccgttccggcaagattgtgtttgagctggaaaatgtcgactacgcggtcgatggcaaagtgctggtgaaggacttctcaacccaggtgcagcgtggcgacaaaattgcgctgatcggaccgaacggctgcgggaaaactaccttactgcgcctgatgctgcagcagctgaaagctgaccatggccgcgtgcattccggtaccaagctggaagtcgcctactttgaccagcatcgcgctgaactggatccggatcgcaccgtgatggacaacctggccgaaggcaagcaggaagtactggtcaacggcaaaccgcgccacgtgctgggctatctgcaggacttcctgttccatccaaaacgtgccatgacgccggtgcgcgccctttcgggcggtgaacgtaaccgtctgctgctggcacgcctgttcctgcgtcccagcaacctgatgattctggatgaaccgactaacgacctcgacgtcgaaacgctggaactactggaagagctgattgatggctatcagggcaccgtgttactggtgagccacgatcgtcagttcgtcgataataccgttaccgagtgctggatttttgaaggcaacggtgagattggtacctttgttggcggttatcacgatgctcagcaacagcgcgccgcctaccggcagcacaaggcggcagcaccggcgaaagcgacgggcaacgtctctaagcctgcagccgagaagggtgatgcgaagcgtagcgtgaataaactcagctacaatctggcgcgtgagctggaacagctgccgcaaaaactggagcagctggaagcgcgtatcggagaactgcaggcgaagatgagtcatcccgacttcttcagtcaggcacacgatcagacgcaaccggtgctggataatctggctcagactgagcaggagctggaaaccgcttttgcgcgctgggaagagctagagtcactgaaaaacggcgcgtagggcagggctaacggatgtgttcagcagtgaaaagtaacgcgtggatgctctgtccacaatgcgatttaatgattaagctgccggacattcccgttggcagccgtgcgtcatgcccgcgctgccacacctccctgacggccaactggcacgaaccgcgtaaacggccaacgggctatgcgctggcagcggtgtttatgctgctgctggcgaatctgtttccttttgtctcaatgaaggtggcggggctgaccagccagataaccctggcgcagatacctcaggtgatggtgacggaagattacagcagtctggcgacgctgttccttctctttgtgcaggcggttccggccttctgcatgatcaccattatccttctggtcaatcgggtcccgttgccgactggactcaaaactggtctggcacgtattctgtttcagctgcgtaactggggcatggcagaaatctttatggcgggcgtgctggtcagtttcgtcaagctgatggcctatggcgagatcggcctggagaccagcttctggccgtgggttttctgttctgtctgctgcagttgcgggcctttcagtgcgttgatcgacgcggcttgtgggacagtctgtccccccggcctgcactgccccatccgcccgaagtgggcatcagtggtttagagcagggtctgcgctcctgtccctgctgtacggccattctgccggaagcagagcataagtgtccccgctgcggcgttacggccgaggcacggcgtaagcacagcctgcagtggacgctggcgctgttgttcacctcaatactgctttatatcccggccaacctgttgccgatcatggtgacggaaaccctcggcactgcctatccctccaatatcatggcgggggtgattgtgctgtggggtgatggctcctatccggtggcgctggtgatctttatcgccagtatcatggtgcctacgctgaaaatgctggcgattggctggctttgctgggatgccagcggacgcggacagcgtgacagccacaggatgcacaaaatttatgaagtggtcgaatttgtaggccgctggtcaatgatcgacgtgtttgttattgccgtgctctctgcgctggtgcgcatggggcaattaatgaatgtttatcccgcgtggggggcagtattgtttgcaatggtggtgattatcaccatgattgctgccatgacctttgacccgcgattaacctgggatcgtgtacgcgaaaacaatatgaaggagtcgcgccttgacggaaactaatcacggccatgcaaaggtggaacagattaagcgctggtcgccggtctggattgtccccatcgttacgctgttaatcggcggatggatcctcttttatcacttcagccatcaggggccggaagtcaccctcatcaccgaaaacgccgaaggcattgttgcgggtaaaaccacgattaaaagccgcagtgtggatgtcggtgtggtggaaagcgcggtgttaagcgacgatctccaccatgtggaaatcaaagcgcgcctgaattcaggcatggaaaaactgctgcacagcgacagcgttttctgggtggtgaaaccgcaggtgggtcgcgaagggatcagcggtctcggtactctgttatccggtgcctatatcgaattacagccgggcactaaaagccaggcacccgagcagtttaagctgctggatgcgccgccgttagcgccaccggatgccaaagggattcgcatcgtgctggacagcaagaaagcgggtcagctcaatccgggggatccggtgctgttccgtggctatcgcgtcggtacagtcgagaccagcgcttttgataccgaaaaacgcatgatgacctatcagctgttcgtcgctgcgccttacgatcgcctgattacaaccaatgtgcgcttctggaaggacagtggcatcgccgtggatatgtccgcttcaggaatgcgggtggaaatgggatcgctgaccacgctgttcagcggcggcgtcagttttgacgtgccggatggctgggagctgggtcagcctgcgcagaataagtctgactatcatctgtttgacgatcagcgcagcattcaggactcgctctacaccaaccatattgattacctgatgttcttcaccgactccatccgtggtctgcaggcgggggcgccggttgagtttccgcggcattcgcctgggtaccgtctcagaagcgccattgatgaaagccggtctggaccaggcgctgaacaatgattaccgcgtgccggtgctgattcgcattgagccggatcgctttatcagccgactgggtgagaacttcgatctgcaacagcatctgcaggatggtaaaaaacgtggcctgcgtgcgacgctgaaaaccggcagtctgttgtcgggtgcgctctatgtcgatctcgacttctatgacaatgcaccgccttacaaagggccgcagaaagtctctggctatgaagttatcccaacggtcagcggtggcctgagccagattcagcagaagctgatggcggcgctggataagatcaacagtctgccactgaacggtatggtcaatgaagcgacaggcacgctgaaagagagccagaaaacgatgcgtgatctgcagcgcaccatcgacaacatcaacaaagtcaccgccagtccggctatgaaaaccctgccggaagacctgcagcagacattgcgcgagctgaaccgcagcatgaaaggcctgcagccaggttcaccagcctacagcaagctggtgggggatatgcagcgcctggataaggttctgcgtgaactccagccggtgttaagaacgcttaacaccaagagcaatgcgctggtatttgaggcaaaaccgggacaggatccccagccgaagagggcgaaacagtgaataaaggattgatactttgtgccgcgctggtgttgagtgcgtgcagtagcagcgttgacaatacctggtatcagctgccctccggggcggcttccatgcaggtcagcagcagccagctgaatgaagcgcaaccgatgttatgggtgcagcaggtgacggtgccggactatctggcaggcaacggactggtttatcagaccagcgatgtcaaatacgttatcgccgcgaataatctctgggccagcccgctcgatcagcagttgcagcagacattgatcactaacctgagcaaggcgctgccaggccggctggtagccggttcacctttaggcgcgcagcacgatacgctgaatgtgaccgtaacaggcttccaggggcgctatgatggcaaagcagttgtcagtggcgaatggacgctggaacatcagggccggctgaccaaacagacgtttaacctggtactgccgcagaccgaagatggctacgatgcgatggtcagaacccttgcggcgggctggcaacagactgcacagaagattgccaatagcgtggttgcgttaaattaagattgatgtgaataaataagctaagcccctgaccgattgtcgtgctttcccgacaggggtcaggggcttttttattagcttaatcagaaagatagtgttgtcgcatgcatcacagaacgtcattatttttaccgattaaggtcacatttatgacactggcatgaagattgggcattgatctttgggtgcgcaggaggtagaacataagggtggttgaacattaattcaccacttttctttccaccagattccacagaccttacatgagggacacggagtatgaagagacagaaacgagaccgcctcgaacgcgcccattcacgtggttatcaggcaggcattactggacgctcaaaagagatgtgtccgtatcagttgattgacgctaagtctcactggttgggaggttggcgacaagccatggaggacaggtcggtagctgcataaccggatgtcactgaaaagggaatataacctccgccatgcgcggaggtttttgtttccgggggaaacacttagaaagcggcggtatctttaaacaggccgactttaagatcgctggcggtatagatcagattaccgtcaaccagcacttcaccatctgccacacccataaccagtttgcggttaataacgcgtttgaagtgaatgcggtaagtcactttcttcgcatctggcaggacctgaccggtgaatttcacttcacccacgcccagcgcacgacctttaccttcgccgcccagccagcccagatagaaaccaaccagctgccacatggcatcaaggcccagacaacccggcatcaccggatcgccaataaagtgacagccgaagaaccagagatcaggattgatatccagctccgcttcaacaaagcctttgtcatatttgccgccgtcttcggtcattttgaccacgcggtccatcatcagcatgttgccggatggaagcggcggaccattttcgccaaacagttcaccacgacctgacagaatcagatcttctttggtataggattcgcgtttatctaccatgttttcaataagccttgttttagtgaatcacgaatattagcgaacagttgtatgctgagcaaatcggattaacggtggttgaaccagttaagccagcgcagcgcccagggacgttgcggaccgtccggctggttgaacaggctaatgcgttcctggatggtattcagcaggcaatcgcccaggccatcctcggtactccagattttaccggtcagcagcggtagcgcttcatcggcacggtcaattgcccagatatggaaatgaccctgttcaaccgcactgacaaccgcctggctgaggctgagatgacggacattgctggcgggaataatcacgccctgctgacctgtcagttctcgctgatggcagatatcaaagaagccttcgattttctcattcagtccgcccaccggttgtacgttgccgaactgatcaaccgagccggtcaccgcaatttgctgattgatgggctgattagccagcgcgctgattaaggcacagagttcagccagtgaagcactgtcaccatccacctcggagtaagattgctcaaagaccattgaggccgagaagggcagttgctgatcgagttccagttcggcaatcaggtaagcctgcataatcatcatgcctttggcatgaatattaccgcccagctccgctttgcgctcgatatccatgaattcgccatcgccgggatgtaccacgcaggtaatacgcgagggatcgccccaggcacggggatggccaggatattcaacgaccgacaggccattaatctgaccaaccacttcgccttctgtttcaatcagaatctgtcgcagcaggatctcgtcacgcatccgctcattgagataattctcgcgccacaaacgcgcttccagcgcatcacgcagcgcttcagcgttcagttcatcgcccatcagggccgattcgcgcatctggcgttgtagccagcgggggcagagtggcagcgtttcctgatcgccgctgtagcggacgccttctttaatcagttctggccagaagtccgcttccggctggggcagacccgcctgttgcgccagttcgatgttccagcgacaccaggcaagcatgtcatcttcatccagaatctgaatattctcttcaaattcagtatagatggccatttcgtgagcttcgggatccagctcctgaaattctgccagcgcttcccgatcgccacacaggaccagtttcagattgaggggcaagggaggaatcgagactggcagcggccggcgttcatcctgagatgtccactcaacataaccctgctcaatacactttttcaggcgtaaccagagaatcggctgcgtcatcaggctacgcagtgaaagcagcagcgtgccgccattagcacgatggatcaggcccggttccagctggatgcgatctttatactggcgcacgcagccaaacaactgctccatctcagtccattcagcaaagtgaataccaccctgactggtgaatgggcgttgaggatcggatgggggctggagcgtgacgttgtcggccatgatatggtaatcaccgccgaatagagtggtactgtcggccataacccgctctgcggcctgggcaatgaatgtcagataatcgcgattctcctggctacgaaccagcagtaacgggaaaccctgcgtctgatggtgtaaatgcgccagtgcattcagcaaccggggctgtaccgttgccagagcatcagtttcttcatcagcaattcgggagaaaacggattggtattgcgcgctatctggctgtaaggtctgccacgtaagttgagtgctggtcaaaataatcgcatttgtctgttttaagaaaagcgagattatacaggattcacccttgttaagcactgcagacttcctgttgaagatgtgatggtgacagcatgtttttcgttgctgcatccgggaaaaaagctgttattcttagttcgttacgtgatcacgatgagattccgatgaaataccagcaactcgaaaatcttgaatgtggatggaagtggaaatacctggtgaaaaaacatcgggaaggtgaactgatcacgcgtcaccttgagttaagcgcggcgcaggcagcagtggataagctgctggcaatggaaaataatccggttacagtgaatgaatggatcgcagaacatattcacgctgatctggataaccgactgaagcagaccatccgtgcccgacgaaaacgccatttcaacgctgaacatcagcatacgcgaaaaaaatcgatagacctggagtatctggtctggcagcgactggcaggtctggcacagcggcgcggctgcacgctctctgaaacgattgttcagctgatagaagatgcagaaacgtaaagagaaatatgccactcagatgtcgagcctgaagcaggatttgcaggcgattctgggtaactccggttcagagagcaaataatcgggcagggcaatcagagcctttatccttcagtccggttttattaccggcataaaaaaaccccgccttagcggggtttttttattacgtgtaaacttaagcctgtggctgagttacaacgtctttgatacctttaacgtcgatttctacacgacggtccggcgccaggcagtcgatcagggcattacggcctttcacgctgtcacaggtgttgccggtaactgggttagattcacccatgccacgtgcagagatcttgttagaaggaatacctttagataccaggtaatctacgactgactgagcacgtttctcagacagtttctggttgtactgctctgaaccgatgcgatcggtgaagcccagtacgacaacggaaccatctttaggatccattgagctcagctggctgtacagctgatccagagcctgctggccttctggcttcagggtagatttgttgaaggtgaacagaaacgtcagacttcagagtgaaacgcttggtttcaacaactggagctggtgctggagccggagctggcgccggagcagcgacgtcatcctgaccgaagcggtatgaaacgcctacgctcagcatgccgttgtctggacgagtaccaacggtctgtgcatcaccgatgttgttaacccactggtaatccagacgggtagcccagtttttggtcagcgcatattcaacaccaacagcagccagcggagatacgccggtgtcgtggtcgctgatgcggccagtagttgagttagtctgcgttgagtctgcacgccataccatgccgcccagacgagtatacacgtccagatcgtcatagattgggtagctcagtttagcagccagctgaacgccctgtgctttgaatgcgccgttagtcacgttgcctttgttaggcatgcgacccagccagtcatagcccagctcgaagcccaggtatggatttgcctggtaaccaacgaatgcacctgcacccagctggctttcatgagttggaccgtcattgttttcgtaaccgttaccgtagtaaccagtgtcgtgatactgagaccagcccagtttagcaccggtgtaccaggtgtcatctttcggagcggcctgcgctacggtagcgaagccagccagtgccactgcaattgcgatagctgtctttttcattttgcgcctcgttatcatccaaataggcaatgagcaaaaaggttgctcttggtttaaatccttcgccgggtcaaaacgctcgcttatgactctaccgcaaaaaacggaggttattgagcaccctggcgagctaaagtctacaacgagattggaaacttacaagtatgatgtgaggcgcttatgtaaaaaaacagcgatttatacacaatttctaacaattaggctggtcttattgtcgcggcaaaaagccctaaaaacttgctaaaccattgtcaacgctcgaactaacagaatcagtggtttagctgcgacagataagaaaaatagcttgggaaacttctgatttttacttaatgaaacaaatccgactgaatttttatcgcagtttgcggtctgagaggcgcttctgatgtcccgcttgcacgcaaaatcaatcctaacgcttcaccctctgccgccgcattttcaagttgacgtcgttcatcttcgtcaagatcgtaaggaatccatgccagaaacgacactgtaatttcctgtacgcaatgctttaaccatcgcttcaaccgcattcagacgttcagaatcggcgatatgcatacttttatccagtggtaatcctgattcctgcagccaggtgcgattcagtttatatgccggtgttaaccacaactgccagcgtgattgctgactcagctgctgcaataaaggcaacagcaacatctgcatcataccgggctgttcgctgtagcgtaactcagtaattccaccgccctgagaggccggaacggaagaggacgcataatgatgagcatagcgtgaattattaggatgttgtgttcgcataagttaatcaccagcagtggactgtatgaatatacagtactgtcatcctggataaagatcaacccaaatttctgaaaacgcctcgcaaaatcgcgacaagattagttgaaacgctatttattcattgaacccgttgacgcttttttttatcttctaattacctgatacccaaggtaatttacgatatatttcttacatggaggtggtgcaatgaaaaaggtgaatccggttgtagagcgctccagagcgcgcctggccccattaggaacaatagagtcgcgcacccagttcggaggctatgccctggctgtagaaagtgtggtttttgccttaattaataaagacgaactctatctgcgtgccagtgaacctttgcgggaataccttacagatcgtccgctgcaacccctgatttttcgcaagcggggcaagctggtgagtctcaattactttcgggtcgatgaggcgttgtggcgcgaccctgaccatctgctggcgctctctgctgcctctttagaaacggcgcagctggagttgcaggaccgacaatcctcaccgcggttaaaagatctgccaaatctcagcgtacgtatggagatgatgctgtacgaggcgggcgtcatgagcgtcaatcatctctaccagatgggggctaaacagtgctggctgaagcttaaagcgatcaaccagcacgttgggttccagacgttacttgcgctgcagggggccatcacgggccaccatgccgccgcgctgccgcaggcgacacgggcggagctgaatgcgtggttccagcgcacgcttttatcaaaccccaatctcagaagcggcgaaggctaatcagtgattagcgtgcggcgcaggcgagccacatcgggcattaatgccaccagcagaccgagttgctggagcaccagcggcgcacgcgtatccgcatctgcggccagctggctgattcgctgagccagttgatggcgcatcatttctacgtgctcatcgctgacaacttccgtttgcagcacatcctccacatagcaaaccgtatcatccagcaatgtcagcagttcgggtgcggtaattttatcgcggtgagcgcccagcgcagaaatgtaactcagaaacgaatggttggagcaaagcagctgaaaagccgaatcgcgcagcttctggctggtgcgactttcactgctcatgtttgagaccactgacgccagttcagcatccgcgttatgcgcatcacgccgtgcaatgcgataggctagacggttatctttgccctgatgatattgctccatgatcgcgtccagatagcggcaattcgctttcagcgttcgttctgccacggcaggtaactgacgaaagcgccagtctggccagataaacgcgacagccagccaggccagcccacagcccagtagggtatccactacccgcggcagggcaacttcaaatccttcacccagcaggttaaagcagagcagcaccagcagagtgataaacagcgtggcctgtgcatactgcacctgcctgaaagcgaagaacaatacgcccgtgattactatcaggattaactgaccttcaatcgaaggcaccagccataaaacgggcagaccaatcgcaatccccgccagcgttccgccgatgcgcaaggccagccgtcgctgcgttgcattgtagttgggctggcagacaaacaggctggtcagcaaaatccagtatccccgctccagcccggttacctgaataaaaccatatccaatacagagcaccacagacatgcgaaccgcatgccggaacagcgccgattcgggagagaggtggcggctgaagcgcagccggatatcactccagccactcaatccttcgcgtgacagcagattgtcgctgtgatgaggatcttcaccggccagcgtctgttctgattcgatcgaagcaagctgtgcgtcgatggcgcgcaggttgcgcagcagccagaaaagagcacgggtatgcgtagcgtcgggatcatgctgctccagacgttctatcgctttctgtaatcgttcaaatgcacgctcaaaacggctgtcatgcacccacctttgacgcatcagaatgcaatgtgccagctggcgacaggcctgagcctgcatattcagcagacgctgaaagcgaaacagaatttcgttgtagcgccagtcgccgcgcagcagatgatattgcagatgggaagagctggctcgttcatgaatatcctgcgccacaaagtagtagtgcagactacggcgggtgccgcgcgacccgcgatcgccgcgcaggcgactctgcagtgtggtcttggtcagattgagctgcgccactaactggctgttgaccatcgccgcatcgataaacgcggcatcatcctgatcgcccgcgtcgggatcgaaaagattcgctttggcatcaaggtaacgcgccagttgtgaaaaactcccggccagctgttcctgcaccggccggaccggaaacatcagatggcccagtaatgtcagcaggttgtaccacagcgcgccgaccagcagcagcatcggctgcatataccactggctgaacagtccgatgccgagcatggtatagaccgcaatcagcagagcaccaaaggcgatagtcgcgtagcgctggccaagggcgcccagcagaataaagccccaggtcgagattgccagcccgataataaaggcgaaacggataaggaaacagtaactcgactgaaaccgaggcgatgcagaagcagagcagggtaatcagcagattcttcaggcgaccggccaggcgatcatcgagatcggccagcgcagccgcgaccactcccagggtcagagggatcgtccactcaatctgatgcagccaccagggaatggcggcgcagccactcagtgcaaacaggatccgcagcagatagcgccacgtactgttaaacagatatttgcgccagcctggcacggcatccgacatcatattagtagcggcggacattggcttcgcgcgcggcacgcgcctcttccactgacaccacccgacggccaaccggccagagcgcgatagcggcgatcttaaagttcgcaatccctaccggaataccgatgatactgatgcactgcacaatccccacggagatgtgcgaaaggcagagccaccagccgaagaaaatcagccagaagatattcagaaaggtgccgccggtattcagaatatgactcttactttccggacgcagcacatcaacatgcaccgcctcgttgccaaacggcagcagcgagagtttggtgatttcccagcaggagcgggtcagcggcagagtaaaaatcagcacgatgctgattaacgtggcaaacagccagctcagggtggtgaaaaaaccgcccagaacaaaattaagaatatttaaaacggtgcgcatgatcttcttttccttttgcattccgcaagatgtgacgccaagtttagcctgttttaaggctggagcgctaagggtctgacaggtaaactccccctaatcctattctctgacgttggtgtcggcgtggaactgaaagcaacctcgatgggcaaacggcttgcccagcatccttataatcgtgtccgtttgatggcggcaggcgtcgaagtcagcggcgataagcatgagtatctgatcccctttaaccagttactggatatcgcctgcaagcgcgggctggtgtggggcgagctggagtttttgctggccgatgaaaaagtggtccgcctgcatggcacggaatggcaggaaacgcagcgctttcaccactatctgctgcaggcctggcagagctggagtctggagatgagcgcagtgtgccgcgaggtgctgcaggcgctacgcgacgaaatcgaggcgtttggcgcgcaggatcgctggctgaaccgccacgagttacaggcgctgaaaaccaacatcctcaaacagttcgatgcattgccgatgccgctctcccgcttaaaagattttgctgactgccgggacaactggcaattctgtcagcgctggctggagcagggcgaaacggcgttgcggcagcgaaaccgcgactggacggccgccatgctgacccgctatcaggatttctttgccagcgtcgagagcacgccactcaatcagtcgcaatgtgaggcggtggttaatggcgagaattctctgctggtgctggcaggcgcgggcagcggtaaaacctcggtgctggtggctcgtgcaggctggttaatgcagcgcaagctggccagcgccgatcaaatcctgttactggcatttggccgccaggcggctgaagagatgaacgcacgtatccagtcgcggctctccgccgctgacatccaggcgcggactttccattctctggcgctgcatattattcgtgaaggcagtaataagcagccggttatcagcaaacttgagagtgatgccgatgcgcgtcgcacgctgctgatccagcagtggcggcagcagtgccatgagaagaaggcgcaggcaaacggctggcgtcagtggctgcgtgatgaactggagtgggagttgcccgaggggccattctgggaggacgacaggctggcaaaccggctggcgtcacggctggagcgctggcttggtctgatgcgcatgcatggcggcgcgcaggcagcgatgatcgccgacgtgcccgaagagatccgcgatctcttcagtaagtgcattaaactgatggcaccgttgctgaaagcgtggaagagcgcattaaaagaggagggcgcggtcgatttctcgggtctgattcaccaggcgattgccattctggaaaaaggacggtttatcagtccgtggaaacacattctggtggatgaattccaggatatctcgcctcagcgtgccgcgctgctgagcgcattacgccagcagaataagcgtactgcactgtttgctgttggcgatgactggcaggccatctaccgctttagtggggcggagatgacgctgacgacggcattccatcactattttggtgaaggagaccgctgcgtactggacacaacctaccgtttcaacgaccgcatcggcgacattgccaaccggtttatacaacagaatccgcagcagctggcaaaaccgctgaacagcgtcaccaaaggcaataaaaagtcgatttcgctgctggcgcaggatcagctggaagccttgctgaacaaactcagcggttacgcgaagcctgatgagcgaattctgctgctggcgcgttatcactatctgcggccggatttactggataaagccagaacccgctggccaaagctcaatctggaatttatgacgattcatgccagcaaaggtcagcaggcggattacgtcattttgctgggattacaacagggtaaagagggcttcccggcagaggcgcgcgaatcgattattgaacagggcttattaccgcagccagaagcgtttccctgatgcagaagagcgccgtctggcctatgtggcactgacgcgcgcgcgtcagcaggtttttctgatgttcgataaggcagcgccgtcaccgtttgtcgatcacttccgcgagctgggtgtgccggtgctgcgtaaagcctgagttacttcagacgatcggccagatagcgctgatagtcggggatcataatctctacactttgcgcaaacagtggcgactgaatgataaagtcagccgtggagcggttagtggctaccgggatattccatacggtagccagacgcagcagcgctttgacatccggatcgtgcggcactgcgttgagtggatcccagaaaaaaatcagtgcatcgatctttccttccgaaatcagcgcacccacctgctgatcgccgcccatcgggccgctcagcatggctgtcacattcaggcccgtatcgcgattgatcagattcccggtagtgccggtagcatagaggatgtgcgattccagcgcgggctggttttgtttcacccagtcaagcagggcagctttgcagtggtcgtgggcgaccagcgcgatatgttttgtggtgccgagggtacgaacagtctgttccataaaggcgtcctggtaaggcccatgcgcaagaagagagagcatgagtgtacctctggcctttcgactctatcaactcgtacgtagcattttgaccagcgtcagaagctgctgacgcgtggcttcatcgaagcggtgaaaccagcggtgcagcgagggcagttcggcctgagtagtccagtccagatcggcggtaagccggacggaagagggcgttgcagaaggggtatttgcaaaccggggcacagaggcaatctggcgggtgcgattataattcagcatcgctttttccatatctgcggatgtggtgaccggcaggtggtcgcgcacgctggtaatctccgtgcctttttcatccaccagctgaaagttcaggctgcggtcaaaatgataacgctcgcgttttgtctccagcgcaggcaaccgaatggtgatggttttggcaaccgcggtgaacgtgacaatcatcggtaccgactgataagcgatgacgttctcattctgacctttgcgctgctgctcgacccgaaacagaaactgatgctgaccgcggtccagctccaggctgtctgcgcctttgaggagggagcctgaaatttttcgaccatccagcaccagcaaatcgatctgaggatcgagctttaatgtgatggcagaacaggacgccgaaacgaggagggtaattaaccccgttacagccagcgacagcttcatttcaactccggtaactgaagacacaaaggatggtgtgtagcaaattcttacattatggcagttaatttacatttaaacatatttattcgtgcgcgggttcaattaattttgctgaggacttacccgctaaagggcacgccaatctacactcaacactggcctgaaaggagataaacatgaacgatcagacaattcgtgaggtgctgacgcgcacccaacgtatcgccttagtcggagcaagcgatcgccccgaaacgtcccagttacggtgtgatgaaatatctgctcgaccagggatatgaggtgatcccggtcagcccgaaactggcagggaaaacgctgctggggcagcaggggtatgccagcctggcggatgtaccgggcaagattgatatggtggatgtctttcgcaattctgaagccgcgtggggcgtggcccaggaggctattgccgttggggcaaaaacattatggctgcagctgggcgtgattaatgagcaggcggcggtactggcacaggatgcgggcatgacggtgattatggatcgctgcccgaagattgaaattccgcgtctgggaataacgcgtcagaaatgatgagtgtggcggcagagcgtgccgccacagattaatgtcgcagatgaggtgcctgtaattgctgacgcaccgatgctgccagctcatccattgaaggctgctctgggtgttcaatgctggtttcgccggaaagctgaatctcagcaacgtaggtatgtacctgatcgccttcctcatcttccatcaccacatgataccagggcgcggtgcgcattttctcttccgcgccaacatcttcaattttaggctcatctaacgagtattcaggatcgacatcgacgataacgcccagtacgccggacaaacgatgacgaacctgctgaccaataccaaatttactggcaatcattgtgacctccgaaaaaaaagctctcttaccaatatgggggcaggagccgttttttcaagtcacatgacgcggcaggcgaaacctttcaggtagagaccttccggatagctggcgatcaccggatgatctgcggcctggcggaactgctcaataaactgcacttcacggcccgcatccagcgcggcatcggcgatgatcttctggaacagatcggtggccatcagaccggagcaggagaaggtcattaatacgccgcccggattcagtaactgaatggcgagcatattaatgtctttatagccgcgacaggcgcccatcaactggcttttgttttcgacgaactttggcggatccataatgatcagatcaaatttctcgccactgtcacgataacggcgcagcagtttgaaaacatcatcacgctcaaattgcgcgcgggagagatccagctcattgagttcaacgttctgacgggcaacgtccagtgcctcctgtgaggtatccacgctgatcacttctttacagccacccatcagcgcagaaaccgcgaatccgccggtgtaagagaagcagttaaggacgcgggcatcctgtgcgtaacgacgcgtggcgagacggctgtcacgctgatcaaggtaatagccggttttgtgaccgccctggatatccaccagcagcttcatgccatgttcggtaatcggcagcagcggcggtggcagttcaccggtaacggtgccctgcgtcagcgccagcccctctttcttacgaacggcgacgtcagaacggtcatagatggcgcagccagggaaacagtgctgcagggcggtgatgatcgctgcacgctgatattctgcgcctgctgagagcagctgcatcactaaaaagttgccaaagcggtcaatggtgacgcccggtaaaccatcagattcaccggcgatcaggcgatagctgtccagaccatcgcgggccgccagccattcgcgccactgctgcgcctgttcaaaccggcggacaaagaaggcgatatcgatggattcatcggcctgccagctccagacgcgggcgcggatctgcgactcgggtgaataagcggcgcgagccagccatttaccgttgctgtcacaaacgtcaatggtttcacccagttgcgctttaccttccagacgcgcaacggcacctgaaaagacccatggatggcgacggagcagggacttttcacgtccctttgcgagaatcaatctgactgtcatagtttgctatgcttacctgaaaaaatgaggcgccattgtccggtggataacgggaaattgcaacgaacagcagcaggagagaataatgtcagcagcctgttttaaagcatgggttcatggccgcgtccagggcgtcgggtttcgttacagtactcaggcagaagccaggacgctgggcgtactgggctatgcgcgaaatctggatgacggcagtgtcgaggtgctggcctggggtgaggcggagcaggtcgatgcgctgatcgcctggcttaaagcgggcgggccacgcagcgcgcgcgttgaaaaggtgctggtggagccgcaccagcccgcagagccgccccgcgattttacgaccggttaattacagacatttcgccggtttaggcaggccggcgattttcgtcgcctgtttagccggcccttcagggaaacaggcggaacagatagcggctattgcctttctcttcgccatatttctgcgccatcgccttcaccagcattcgcacggcgggtgaggtgttatattccagataaaaggcgcgcacaaaatggaccacttcccagtgtgcttcagtcagggtcaggccttcctgctcagcgatgtggacagccagtgcttcactccagtcgccgggatgcttcagatagccttcggcatcgacggcgatttcgttaccgttaaaattcacgtgacatcctcttagtaaatgacggcgcagtttatcaaacctggcgggcagtaaaagcaaaaaccccgccgaagcggggttttacaggccactgtcactgcggattagttactgcgggcaaaccccagcaggctcagcaggctgacaaagatgttatagagcgaaacatagaggctgaccgtcgcccggatgtagttggtttcgccaccgtgaatgatgttgctggtttcccacaaaatcgcaccggctgaaaacagaatgaacagggcgctgatggccagatgcaatgcaggcagctgcaggaagatgttggctaccacagcaaccagcaacacaacgaaacctgccatcatcatgccgccgaggaaggacatatcacgacgggtggtcagcacgtaggccgaacagcagaagaacaccagcgccgtgccgcccagcgccagcgctatcacgtcacccatgcctgcggttaagaatgagctcaggataggccccaggcaataacccaggaagccggtaaaggcaaaagcggccagaatgcccatcgggctgttagccagacggtaggttaaaaacattaagccatagaagccaaccagcatcaggattaaacccggcgcaggcagggccagcagggtgctggcggtagccgtaacggccgagaaggccagggtcagtccgagaagaaaataggtattgcgcagaactctgtgcgtagacagcagtgaggactgcgatgaggtgacaattctttccatgttgcgctcctttaagcagaacaccaaatatgtgccgagaatacgcaggccattaaagagggaaaaggcgttttacccttctttacgcgctaaactgctaattgtttgagcagagtggcgattttgacaccgaaaaatcacaatctggctgtttttcaggcgaatagacagataggtgctttacatccctaaacggggtgtttatagtgcgcgtcattgcggaggggtggccgagcggcttaaggcagcggtcttgaaaaccgccgatgggaaaccatccgagagttcgaatctctcctcctccgccactttatctgccctgggcaataaagcggcaaaaatagatgttttgccaatgcagtacagtttcaaaacggaggggtggccgagcggcttaaggcagcggtcttgaaaaccgccgatgggaaaccatccgagagttcgaatctctcctcctccgccacattttacaggccagcacgcagtgctggcctgtttcgtttctgctctctctgttacttcttcctgtctgaaaaaagcgtgccactctctgtgacgcgtggctgcgcattcatctctccggtgcatctctgctatagtccactcaccgtttttgcaaacatctggcgcttttctgaggcgagctgagttacactgttgattacatcgctctgaggcgagctaatgggttgatagccagagtgtttctttactgaatgaatggaataggcacaatgatcaagaaactgagtctttgcgcattgtcagtgctcgctgcattgccggtcggaaacggtagcatttgctgctgagggtgatatgcagctgcaacaggtgctgatgttaagtcgtcacaatctgcgtgcaccgctggctgataatggcagcgtgctggcgcagtcgaccaaaaaaagctggccgcagtgggatgttcccggcggacagctgaccacgaaaggtggtgtgctggaagtctacatgggtaactacacccgtcagtggctggcacagcagggcctggtgaagaacggcagctgtcctgacagcaataacgtctttgtttacgccaacagcctgcagcgcactgtggccaccgcccagttctttgttaatggcgccttcccgggctgtgacgtcgctgtttctcatcaggatgaaatgggctccatggatcctattttcaatccggttatcacagatggcagtgaagcattcaataagaaagcgctggctgagatggccgctgcgaatgaaaaactgtcgctgaagcctgccttccagcgcctggaaaagattgttgactacaaagcatcgcctgcctgcaacaataaaaagcagtgcgatctcagcagtggtcagaacaccttcagcgctgaaaatggtaaagaaccgaatgtcagtggcccgctgaaaacggggaattccctgatggatgcgttcacgctgcaatattacgaaggtttcccgctggatcaggttgcatggggtcagatcaaaacgcctgagcagtggaaagagctgtcagcgattaaaaatggttaccaggatgcgctgtttaccagcccggacatttcccgtgaagtggcggcaccgctggtggactacatccgcagtcagttagtggatcaggacaaagccaacgcgccaaaaattacgctgatggtaggccatgactcaaacatcgcctcgctgctgagcgcgttgcaggtcaagccttatgaactgcctgataccttcgaaaaaacgccgattggcggtcaggttgttttcgaacgctggcatgatgcgaaaaatgataaagacctgctcaaagttgagtatgtctatcagagcgccgatcagctgcgcaacgcagacgtgctgagcctgaagaacccaccgaagcgcgttacgctgcagctggcgggttgtgagaccgatgcaaacggctattgcagctgggatcagttctctcaggtgctgaatgctgcgttgcagggcacgccaatgcagccagtggcggcaccacaaccggcagcccagtctgacgacgacagtgcgaaagccgcagcgaccaatgacgctgctgctgataaggctgaagcggataaagcgaccgcggcgaaagagaaggctgacgccgataaagctgccgctgagaagtctgaagcggataaagccgccgctgaaaaagcaaaagcggacaaggcagcagccgataaagctgcagccgagaaggcaaaagcggacaaggcagcagcggataaagccgccgctgagaaagcgaaagcggacaacgcggaagcgaaatcagccagtgccgataaaggtgcggctgaccaggctaacgcctcgaacacgcctgcaacagcgcacaacgacgaatcaaagtcagcggctgtggcaacacagtaatcgtgctctccggctgataataaaaaaccccgtcgagacggggtttttttatggctgcaaggcgattaacccgccacgaccaccagtttctggttagcaaactctttgatgcccaggtcagacagctcacggccataacctgaacgtttcacgccaccaaagggcagctccgctgaggtgtcgctctgggagttgataaacaccatgccggtttcaatggcggaggccagtttacgaccgcgtgcaatatcgcgtgtccagaccgagccgcccagaccatagtgagagtcgttcgccagcgccacagccgcctgatcgtcacctatgacataaacctgcgcgaccggaccgaagaactcctgataataggcgggattatccggggtaatgccagtgagaatggttggctgataatagcaacctgcaccttcgacggctttgccgcccgtaaccagttttgcgccattggcgacggcttcgtctacctgttttaccaggcggtcacgcgcgtcagcggaagagagcgggccaagcgtagtcttctcatccagcggatcgcccagcgtagcggaactcagagcagcgctgaactggctgataaagcgatcggcaatcttctcatgcagaataaaacgttttgcggcggtacagacctggccgcagttgctgaggcgagcctgcacgccctgacgtaccgcttcgtcgagatcggcatcatccagcaccacaaacacgtcattgccacccagctccagcgtcgatttcttaagatgcttaccggcctgctcagccacggcgctgcccgcgcgctcggatccggtcagggcgacaccctgtacgcggtcgtcagcaatcagatcggcgacctgatcggtggagatgaacaggttagtccaggccccttcaggtgcacccgcttcacgaaccagcttctcaaagacatcggcacagtgcggcacgatattggcatgttttgccagcaccgggttacccagcgccagattaggtgccagcacgcgcatcagctgatagtaagggaagttccacggctcgacggcgactaaaacgccaatcgggtgatactcaacccaggcttcgcccagatcgctgggataggactgcggctgcagaatacgttccgcattctctgcgtagtagcgggcaatctgcgagcagattttcacttctccgcggctctgaccaatcagtttacccatctctttactggcgatggtggccagttcttccgcgcggctatcaatcaggtcagccagttttttcaatacctgcagacgcggctgaatatcacctttgctccatgaagaatggaaaaggcgatcggccacttcgagggcatggctgacggcggcttcatcgtgtgacggccagcttttcagcaactggttgtttgcgggattaatgctttgataggaagacatagcgtactccttggtgagctaaaaattgagggcgggaaagtcccgcccctgaatcatacgttcttacgttctacgggcttgtcatcccaggtcaggagatctttatcggttttttcaaaggcgcgaatcagcacgtcatcactgccttgctgacgccagatctcttctgccagtttttcatcgtagttagccacttcgaaaatggcctcggcaatttcaggggaggtatgacgcagacttgcccattcgccaacgtgatgtgctttcgattgttcagtagacatacttttctcctttgattaaatcagtcctgcagtttgacggtcagtccggcaacatgttcgccctgaaaacgggcgatattcagttccgcttcggtaggctgacgcgaaccatcgccgcccgccagggtggtggctccataaggcgttccaccgcgaacctgtgaaatatcgaacaactctttggttccgtagccgattggcacaatcaccatgccgtgatgcgccagggtggtccagacagacgtgatggtctgttcctgaccgccgccggtgccggttgaggtaaagacgctggcaaccttgccaaacagcgcgcctgacgcccagagtccgccggtgcgatcccagaatgtccgcatctgtccggccatgttgccgaagcgggtcggagtaccgacgataatcgcgtcatagtgcggcagcacctcaggcgtggcttctgccgcctgctgatcggttttgccacccacctgggcaaagcgatcggcctccatcgtttctggtacccgcaggatatccacttccgcgccgtgaacccgacgagcgccttctgcaaccgcgtttcgccattgtttcgatatgtccgtacatcgaatagtagagcaccagaatcttagccattgatctctccagatggttttgacgtccagaaaaagtatagaagagctttcgttttacgcaggcgatgccgaagccggaacggaggagtcgggcaataaatcagcagctaatcggttgtaagtcggcagagtgttcgttgtttagccaaatttctggtgattactctgttgctaaatgtgactggcggacgagtgaaaggataatctggctattatttaaacatgggctgagctcgcgtttcgggccgtcagccctctgtttttaattcttaattatcgcactacgcgacaggagcaaatgatgacaacacatcgtgggggttctggaaattttgctgaaaaccgtgaacgtgccgcagaagcgggacgtaaagggggaaaaaacagcggcggtaattttaaaaacgatccgcagcgcgccgcgcgtgccggggagaaagggggacgcagcagtcctaaaaaaccggacgcataaccccacactgccgccggttgagaccggcggttaacgtcgttgcttttccccctcgctctccccacaatattgtccggacacattatcaggtgaattatgtcggacacactccgcggtttaaccctgcgcctgacgcggcaggagctggtattacttttcataaccatgatctggggcggcacctttctggtggtgcatcgtgcgatgcagcactccggcccgttcttctttgtcggcctgcgttttgccaccgccgcgctgctgctggcgctctttttccgccgctatctggcaggcatgacctggctggaggtgaaagcgggtgcgctgattggcctgtcgatcgccgggggctatggtcttcagacgtggggaatgcagaccatctccagcagtcagtccgcctttctcaccgcactctatgtccctgtcgtgccgttgctgcaatggctgtttctgcgccgtccgccgggattgatgtcgtggctggggattgtactggcgtttaccggcctgttgctggtggccgggccgcaggatggtcgcatcactctgaatgcgggtgaaatagcgacgctgatcagtaccctggcgatagctgccgagatcatcttaatcagccgctatgccggtaaggtcgatgtgcgccgtgtgaccctgatccagctggcggtggcgtcgctgtgcgcctttggtctgatgatccccaatggggaaacggtgcctgccatctcaacgccgctgctgctcagcgcgctggggctgggtgcggccagcgccctgattcaggtcaccatgaactgggcgcaacgcagcgtttcgccgacccgcgctacggtgatttatgccggggaaccagtctgggccggcgtcgtggggcgtattgcgggtgagcgcctgcctgcgctggcgttgctgggcggcgcgctgatcgtctgcggggtgatcgtcagtgagctgcggctgaaacgaaaaaaagcggtgcagcctgctgccacaccgctggagtaggtcgttaaccctgctgtcgcgccagtggcttgtcctgctttgccgcactgcgtcggcgcagaatcgcattgaggataatcgcgccaaaggtggcggtaccgataccccccagcgtgaaagaaccgattttcagcgcgaaatcaccggcaccgagcaccagtgtggtcgccaccatgatcaggttactgttctggcctaaatcaacatggttctgtacccagatgcgggcacccgctaccgcaatcagcccgaacaccacaatggatgcgccgccaatcaccggtgccggaatagtgtggatcagcgcaccaaacttcggcgagaaaccggcgaggatggcgatgaccgccgcggcgacaaatgccagcgtagagtagactttggtcaccgccatcaccccgatattttcggcataggtggtgacgccactgccgccgatcgagccggagagcatggtggccaggccatcgccaacaaaagcgcgtcccatgtaaggatcgagattgcgtccggtcatgcccgccaccgctttcagatgcccgaggttttcagccaccagaatgatcgccaccggggcgataagcaccatcgcctgcagatcaaaggtgggagcggtggtgtgcggcagaccaaaccaggcggcctgtgacagcagggtaaaatcgaccggcttacccagccccagaccgttggtcagcagtgcatagatcgcccaggccagaatcaggccgaccagaatcagcagtcgctgaatcatcccgtgggtaaataccgctaccagaccaatgcagagtacggtcatcaccgcaacccagctgtcgaatgacgaggcggagacgctgtgaaccgcaatcggggccagattcagcccgatagccatcaccaccgcaccggtcacgaccggcggcatcagattttcaatccagcgcgtgccggacttcatcaccaccagaccaatcagcgtgtagagcaggccgcaggcgatcacgccgcctagcgccacgctgagattgggattcagcccctgaccactgaagccggttaccgcaatgaccacgccgacaaaggcagcgctcgacccgagataactgggcacccgaccgccggtgataaagaagaacagcagcgtgcctatacccgagaccagaatggccagattgggatccagccccatcagcagggggcatcagcaccgttgcgccaaacatcgctaccgcatgctgtaaacccagcaccagcgtctgccccagaggcagggtctcatccggggcgataataccgttttctgttaatgccgacttcttttgccattgcggaaaccaggatcgtgccatcgtctactccagagcgttatgaatgccggtgggattcagggaagcgttaacaggcatcctgccgcaacaggggatggtatccccggtcaaaccacgccagaccgtgggtgtcatcattgcgcactaaccccacgacttcgcagaacagcgtgtcatgcgtaccgacgctgacaatctgagtaatgcgacagtcaaaggacgcgacggcgccgctcagcaccggcgagccggtcacggccgttgaccactcagcggcaataaaccgatcagccattggcgttttgccgccgaacagattggagagcgtttcatggcccgccgccagcgtattgacgcagagctgcatgttttcgcggaacaccgggtaaaccgaggcagagcggttaagacagaccagcagcgtcggcggcgaatccgtgacgctgcacaccgccgaggccgtaaagcctgcgcgtccggccgggccttcagtggtgatgatgttgaccgcagcacccagccgcgacatcgcattacgaaactcagttttttcaacggcaggggtaagggtatccaggctcatcgtgttctccgcgaaaaggttatccgacgacgcgctgcagcggctgcacgtcatcagtctgatccagccactgcagcagcagggcattaaagttttcgggggcggtgacgctcatggcgtggccgccccaggccatcatctgttcagtcgcattgggcagggccgcggccagctcagtggagcagctccatggcaccagcagatcgtcctggctggcgatcaccagcaccggttgtggaatggcagcagcccgcgcgctgaagtcggcgctcatcagggcgtgcagccgccgcatcagattttccatcccctgaaaatgtgcgacgtgatggctatcttcctgatccagccgtgtctgatgctgtgccatccactccgcaggatagagaaacagcggctgagcgcggacaaatgcctcgacgccgacgttgagcagcaggtcctgacgcacctgaaagcagcgacgggtatggggatgcagcgtcagccagccattgatcaccgcgatccgttcgatccgatccggataatccagcgccagctgcatccccatcagaccgcccagcgcgtgcccgatcaggctgaagcgcaggatgccgtgctgcgccagcgcggcggccagttctgacgccatcatcgccatgctgtagccttccggcaggctgtcagcgctgcgaccggtgccgcgctggtcataggtcaccacccgatagcgtgccgttagcgcggccagctgcggctgccagaaacccgccacgccgcccagaccggatgagagcaccagtgtcggtgcatcgggattttgcagacccagaatatccagctgcatcagacctccgctttgccgatgtgcgccacgctggcgatctcaatcagcgcatcaggcttgaccagaccgcactgaatacagaagcgcgccggtttttcgccgggaaagaactcggcataaacctgattcaccgcggcgtagttcgaccagtcggtgataaaaatcgaattaaacgtcacatcggtcatgctgccaccggcggtctcaatcacctttttaatggtttccagcacgtggcgggtctgcgctgcggcatcacccacatgcaccacgttgttgtcagcatcaaacggcagcgtacccgagacatagaccacaccatccgccagcgtgccgggaacgaacggggcgatgggggtggtggtgcctggcggaacaataatacttttcggcatagcgtcgtccttatcgtggattagcgggcattcaggctttcgcagaaggtatcgacatccgatacccagccaaaaaaggtttcgatattgaacagagcagcctgctgagcaaagggcgggccggcctgataagtggcgtcttccagcaccacgccgaagtactccagaaagaagccgtcgcgcagcgtcgattcaacgcagacgttggtggcgatgccggtaaacatcagatgacggatcccgcggctgcgcagcatgctgtcgagcggggtgttatagaagccgctgtaacgcgatttcggcagcacgatgtcaccgggctgtggcaccagttcatcgaccagcgcgtaatcccagccgccttttgacagcagcgacccctgcagttcaggccgtttacgcatggttttcagggcattcgatttgtggaaattgggggaaccggcgtcgcccgcttctacatagtcactgtcccagccgttctggaaccagatgatctgaacgcctgccgcacgggccgccgtcaccgcctgatggattttcgcaatcaccggcttggtggcggaaacatcgaagcccgccagatcgagatagccgccttcagtggcgtaggcgttctgcatatccacgacaatcagcgcggtctggccaggcggaaaggcgatcggctctggccgcgccggcagttcaacctggggaacatccggcgtgtgagcacaataaacggtagccatcatgccacctcctgctgtgcgtcgagcagggcgctgcgacaggccatcagaggctgaatgtgctgcccgaagttctcgataccctgcaggaagtcatcaaacgtcagcagcacgccgtgggtgccttcgacctgcgcaacctcatccagcatccgcgccacgctggcatacgaccccaccagggtgcccatattgatattgactgccgaggtcggatccgccatctggcgcacattggtgtcgctgcccgatttggtgtcctgctgactctgagtggtgagccaggagagcgcctcttcatccgcaccggctttgtagtgttcccacttcgcccgcgcttcttcgtccgtttcagcagcgatgatcataaacagcacataggagccgacatcgcggcccgctttttcagcggcctgcttcatgcgaatcgaggtagagctgaacgcggcaggcgtgttaacacctttaccaaagcagaagttgtaatcggcgtgctgagcagagaaggccataccggcatcgctctgtccggcgcagatcaccttcatcgggcgctgcggctgcggactcacccggcagtcgttcatggtgaagaactcacctttaaagtccgattttccggtgccccacaggtcgcgcagcacggtaacgtattcggtcagataagcgtagcggctgctgaagtactcatcgccaggccacattcccatctgttcatattccggtttctgccagccggtcaccaggttgacgccaaagcgaccgcctgaaatggaatcgatggtggaggccatgcgcgccacaatcgccggaggcagcgtcagggtggcggcggtggcgtagatctcaatgcgtgatgtcacggcggccaggcctgccatcagggtgaacgactcgagattatgatcccagaactcggtttttccgccgaagccgcgcagtttgatcatcgagagcgcaaaatcgaaatggtaatgctctgctttcagcacgatcgctttgttcagttcaaaggtcggcatgtactgcggcgcattggacgaaatcagccagccattgttaccaatcggaataaagacgcctatcttcatgtgaaacctcgttgcgatgggggaaaggtgtttcacgcgctgcgctgcatcctgcatcgtccgtgtgggccgcgctcagtcacaattctgcaaactgtgtgccactttttttattgttttaaataacagtgagttaaaatcaacccgaaagaggtaagtggagtaactggtccatttcagaccgtctggtcaaaattcgctgcacgttttccatgcaggctgagcaaaaaaggtgcagagcgcggattgggcagcgatgaatccctttgctatgatgcgctgacaccagaaggatgaggtaaacgtgtgaataccgatgaaaaaaagccaacgcgacgtttcgcgtgcggtcgcagcgaagcgggccgccatactggaagcggcattaaccttcttctcacagtttggcattcacggcaccagcctcgataaggtggccgagctggccgatgtctctaaaaccaatctgctctactattttccctctaaagaagtgctctatgtggcagtgcttaagcagattctggatgtctggctggcaccgttgcgcgcgctggcgcacgatcaggatccactggtcgcgattcggcgctacatccggctgaagctggaagtgtcgcgcgatcatcctcaggcttcccggctcttctgtctggagatgttgcagggtgctccgcttctgaaaggggagctggcaggcgatcttaagcagctggtggatgacaaagcggcaattattgaacgctggattgatgaaggacgactggcaggcgtacagccgcagcatctgatctttatgctgtgggccaccacgcagcattacgccgattttggcactcaggttgaggccgttaccggccagacgctcagcgatccggcgtttttcgatcaggctgttgataacgtgcagcgcatgatcatcgaagggattcgcgtacgctaattcaggatacatccacggttcaggtacggagttaatcaatggattctgtttcgcaactggtgctgggtgcctcagtcagtgtcgcagtgatgggacgtcgggtgccggtctggcaggccgcgctggtgggcggcgtctgcggcaccttacccgatctcgatgtctttcttgatcatggcgatgcgatacgcaacatgaccctgcatcgcacggaaacgcatgcgctgctctggctcacgctgctctcgccactgattgcatggctggtggcgggtctgtttcgccagcgggtgaagtgggcagcatggtggcctgccatctggctggcgctgattacccatccgctgctcgatttgatgacggtgtatggcacccagcttggcctgccgatcaccgattatccttatgccatcggcagtatctacatcgtcgatccactctataccctgccgctgctggcaggcctgggcgtcgcgctctggcggcgcagtgataaagggctgcgcggaaaccggctcgggctgatgctgagtaccctttatctggtctggagtgtggtgattcagggcgtcgcaggctggcagatcagagcgtcgctggcggagcagggtattccggacaataaagtgctggtgacgcccacggcctttaatacgctggtatggcgcagcgtgattatgacgccggatcgctatggcgaagtttactggtcgctgttgtcgccctcacggccactgcaggtggcgtggtatccgcgtcatcctgaactgttcgacgcttttcggggcagctggtatgcagaaacgtgtcgcctggttcagccacggcttctacgcgctgcgggagcaggacgggcagacgacgattgccgacctgcgcatgggcgaaggcgataagtataccttcacctttggtctgggcacgcctcagcagcccgatccccggccgcagcgcttaccttatgaacgcccctctttatccgccattttctctgcgctgggcgatcgcctgtaaaaaaaagcccggtcatctgaccgggctttgttcatgatattaccgattagcggctacgacgattacgcagcatccagccgacacccagcagggcaaaccagagtggcgtaaccatcagcgcctggcgcgtatcttcctgcagcgtcagcagcaccagcacaaatgcgaagaatgccatgcagacccagcacatgaatttgcccagcggcatcttaaatgccgactccgcatggcgctgcggatgctttttacggtaggccagatagctgcacagaatgatggtccagacgaacataaacagaatggccgagacggtggtcaccagcgtgaagaccttcattacatccgggatcaggtagatcaacgccacaccaatcagcaggcacaggcaggagaaaaacaggccggtagtcggcaccgcacgggcagagagtcggccaaaggcgcggctggccacaccctgctgcgacaggccatagagcatacggctggtggagaagatgccgctgttggctgaggaggcggcagaagtcagcaccacaaagttaacgatactcgcagccgcaggcagaccaatcagaacgaacatctcaacaaacggactgcgatcggccatcacctgggtccagggcgttaccgccataatcaccatcagcgccagcacgtaaaacataatgacccgcaacggaatcgcattaatcgcgcgcggtaacactttatgcggattgtgggtttcagccgctgccgtgcccaccagttcaatgccgacaaaggcaaacaccgcaatctggaagccggcaaagaagccgctgaggcctttcgggaacatgccgccgtgatcccagatgttgctgagtgacgctgtgccgccgcccggtgaggggtagtgaatcgataccagcacaatcccggttacgatcagtgccacaatggcgacgattttaatgatcgcaaaccagaactccatctcgccaaacagcttgacggtggcaatattgagcgccagaaaaaccaccacgcaaagcagggcgctcatccagatcgagaagcccggaaaccagagctggaaataggcgctgattgccaccacgtcggcaatgccggttaccacccaacagaaccagtaggtccagccggtaaagtagcccgcccacgggccaagcagatccgcggcaaaatcgctaaaggatttgtactcaaggttggagagcagtagctcccccatggcgcgcatcacaaagaacagcataaaaccgatgatcatatagacaaaaatgatcgaggggccagccaggctgatggttttacctgagcccataaacaggccggtaccgatagcgccaccaatggcgatcagctggatgtgacgattgtgcagattgcgctggagtttatcgggcgtttcgtgggtgcttgcggtttctttagattgatcaaccatagaattgtctttcctgtcgtgatgttgtgttcagctctgctggctgttagtcaaggcgtctgcctgagggcaagtcggcataagatagaggaagagagccggaatcgggtaacgcttttttaccaattgtgatgcctgccgtcccggaagcggcaataaagcgcgattttgttcaaaccttcgtcagcctgggtaattattcatcacgttatgtcagtcaggcggcgtgaagggcgatgcgcttctacactttttgtttgctaatcatcatgctgcgagagggactatgcgcacgcttatcctgtttttgctattgcttgcgctgggatgggtcagcttaccctggcttaagcagcatctgccgccgcagtttaatccctttacgccactctctgttaccgatccgccgggctggatgacgcagattaagatgaaaaggctggccagcgatcctgacgcatgtctggcggtgatgcgccgcgctcaacaggcgggctgggtcagcttcagcgagcgtccggacgtcacgggtcactgtccgctcagtcatccgctgcgggttcagaaatttggcccggtcagcctcagcagcagctttctggccagctgtcctatggccgtcgccagcaccatgtatgctctgcgcagtcgtgaacagaccgccagagagatgcacagtccactggtacgaattacgcatgtcggcagttacgcctgccgtaatatttatcatcgtgcccaggggcggctcagtgaacatgccaccgccgatgcctgggatgtgacaggctttcagctggctgatggtcagcggcttgaggtcagtcgtcactggcaacagccggaagaaaaagcggcaatgcttcatacgctgtggcgtggcggctgtgaggtattcggcaatgcgctggggccggactataacgccgctcacgcctcacattttcatctgggtatgcgaggtgcaggctactgccgataaatcatcagacaggattaataccgtgtttgattaagaaatgttcttatggtgccagtaaaacccatccagttatcattgcggaacctgatcccttactgaaatagtctgacaacaggtcaggatgcgcataaaaaagccgatttcagggccatctgtaagaataaaacgatgcctgcgggataaaacccttgtgcagattctcagcctcatttgctcagcgcctgctggtggcatgatgaaattatttcacggttgcgctggcagaaataagggaaaggtatcgcataaataaagcgtgcgtgattgagaaaagaatggatttttcctgcaaatttattttcatatgatttagttgcgtgactatcgggaaagtgatttaactgattaaaatagagtcagtgttgagcattacgccataaatagtgatctccgccacgtattgcggtcagtcagcagagtaagtaaaggagacttttacgaacgtgctgtcctggatcaggtatttgcagtcagataagtcgataaaccacagcaggatgtgaatcgacgggcacagagcatggtcgggtagaggagaccagaaaaggtttattaaacagcacatcgttacgcttacagggctgccacggaaaaccgggacaggtctttcaccggcaagcgcgtggcgcgggcagcaagccggttagctgcctcaacagacgccacaggggctgcggggacttctgacgaaaccggtcctgatgctgcaaagagagagccgggcttatttcctgataaaaaatatgtcagaaatttgtcactgccgcttcgcttataacggagtaattaacgccttgtttactcgttatttacccaacaatcagcatcgcgattcaatattttcagcagacgtttcgggtctgagataaaattgcactggaggtcagggattgaaatcctatcagaaaaatcttattctcctggggtgattgaaattgctgtgatcggcctcaccttgtaaaggcaggaacactttttcactccgctccaacggtgaaaggttaaatgcgctgtagatcgcgacagattcgtcctgaaagataaattaattttcttctgcaaatttattttatccgatgaatctgaatgaatattaccggaagggcgagtgaaattaacgctgaggcaatatgagtactgaaaattatttcgcctggcgagctgaggcgaaagaaaaatttcaggcattaacggtttcttctgaattgaagccgttattgcaacaatttattgaatcattaggcttcgattattttgcctttttgattcagcacccggtgccttttacccgaccgcgcattcatttacatagcacctatcccagattatgggttaaacgctatgagaagcagaattattacgctgtcgatccggtgctcaggttgtgtcagcgaccgggcagaggcatggcgtggacggaggaaactgttcgctgacgccggcaatttgtggcatgaggcgagagaatatgggctgcagagcggattttcttgctctgcaatggcaccaaatcgcgtcattggtatattatctatatcgtcgcaacagcccatttctgtccagctctgccatgctgagctggaggtgaaactacaccttttagcggaactaagtctggatacgctggaacgctttagcgatgatgcaatgatggtactaaaaaaagagtttagtcagcgcgagctggaaattttgaaatggacagccgaaggaaaaacggcggtcgaaatttcacttattttatccatctctgaacataccgttaactttcaccaaaaaaatatgcaaaagcgtttcaatgtttccaataaaacgcagattgcctgctatgcagcggcaatcggactgatctgaacataaagcaacggctacatttcgccgttactttgcacaggtctgttgtctaccctgcgccgggactttgccaggctggcgcaaagaaatcattgcaaacatggggatgtcagaggcgcatgatgaaaatagtgcaaacgcaattaaaggatatgccatcctctttgcttgccgaactcggcagctaccgatacagcgtctttgcgcgcggcgaagggtggtcaattccgccacgcctgagcacgccaggacaggaatatgatcgctatgatcgttcagatgtcacctggctgatcgcatggaatgcgcgggagggcatcagcggctgtgcgcgtctgatgccctggttcgaacctgaactgagtgaaggcatcgtactgcctttcagccatgagaaagtgtgggaaatgtcgcgcttctcggcacggctggatgtggacgctgaactgccactgaatattctctggcacgccgtgcagctggcagaattgaacggtatggaatacatcatcagttcggcaacgccgatgctggagaagatgtttgaagagcatcaggtggtgtatgagccgctgacgccgggacttattctgtcagaagataatctgtttgcgatccgtattccggtggttcagccagcgctggctgaaaagtatcggggaacgcggcgctttagtccggaagaggtgctgcctacgctgggcgtttcggttaactggcaggcgcacagttaattaatttgcccccgcggctgtgggggcaagcaagcttactgacggtaggctgttttgatctgcttaatggtattgctgaatacttccgcctgaggcttgtcgcccagcgtctgtacatagcgttccatgttgataatcactttgccggcatcagcctggcccatacctttcaggatcagggtgatcatcatcttcagacccgcgatttcatccgctaatttccgggcttcctgcgaagttgcaaaatcttcatcgctcatgcgtttctccttggtgaatgacaatgtgtcggcaatctgtccgaacagcagtgcgtgagtatatcacagggtcagtaagttgctggagcagccggttcgcttcgctataaacagctggtttgtccagtacaactaatcaatcgctgaaagtaattacaggtgttgccgggccagatatcacaagggcctgcagcgataaggcacagcaaagtctggtgttaataccatgaaatagtaagagtttaaggattattcagtacgcctgtcggttgtaagaaatctctgttattgctggctgcacggggctggaaatcgttatgcgaagcgtcgactgttttgctttgttgatgtgcttttgaggtaaaagcgggtatgattatcgcctgtattcgttaattgattcctctttttttagcctctggagtttccccgttgatcagtgtgcttcttgttgatgaccatgaacttgtccgtgccggaatccgtcgcatcctggaggatgtcaaaggtctggccgtggtcggagaggtcaactgtggcgaggatgccgctaagtggtgccgtgccaatcaggttgatgtgatcctcatggatatgaacatgccgggcatcggtggactggaggcgacgcggaaaatcgtgcgttacaatcccgatatcaaaatcatcatgctgaccattcacacggaaaatccgctgcctgcgaaagtgatgcaggcgggggctgcaggctacctcagtaaaggggctgcgccgcaggaggtgatcaatgcgattcgctcggtcaatgccggacagcgctacatcgcttcagatatcgctcagcagatggcgctgagccagattgagccacaaaaagcggaatcccccttcagctgtttgtcggaaagggaattgcagattatgctgatgatcacccgtggacaaaaggtgacggaaatttccgagcagttaaatctcagtcctaaaaccgttaacagttaccgctaccggatgttcagcaagctgaatatcagtggcgatgtagagttaacgcatctggccattcgacatggcctctataatgcggagccgttaatcagtagtgaatgacgtttttgattccaaagcctttctgagtacggtaaccagcaagcccggtgtttaccgcatgtatgacgcctcaggcaccgtcatctatgtgggcaaagccaaagacctgaagaagcgtttgaccagctacttccgcactcaggtcggcagccgcaaaaccgaagcgttggttagtaatatccagcacatcgatgtcaccgtaacccacaccgaaaccgaagcgctgctgcttgagcataactacatcaagctctaccagccgcgctacaacgtgctgctgcgcgacgataaatcttacccctacatctttcttagcagcgatacccatccgcgactggcgatgcaccgtggtgcaaagcatgccaaaggcgaatactttggcccgttccccaacggctatgcggtgcgtgaaacgctggggctgctgcaaaaagttttccctatccgccagtgcgaaaacagcgtctaccgcaatcgctcccggccctgtctgcaatatcagattggccgctgtctgggtccctgtgtcgcgggactggtcagtgaggaggagtatgcacagcagaccgattacgtgcgcttgttcctggcgggtaaagacgatcaggttcttaaccagctggtcaaacggatggaagaggcgagcacgggcctgcgctttgaagaggcggcacgcctgcgcgatcagattcaggctgtgcgacggatcaccgaaaagcagtttgtctcgaatcagggtgatgaccttgatgtgatgggtgtggcttatgaagcgggcatggcctgtctccacgtgctgtttatccgtcagggcaaagtgttaggcagccgcagctacttcccgaaagtgcccgtcgataccgatctggctgaggtcgttcagacctttgtcgggcagttctacctgcagggcagcgaggcacgtacgctgcctggcgatattttgctggacttcaccttgccagagcgtgaactgctggctgagtcgctcagtgagctggccggacgtcgggtgagtattcagagcaagccgcgcggggatcgcgcccgttatctcaaactggcgcgcaccaacgccgcgacggcgttaaccacgcggctgtcacagcactccacaattcatcagcggctgatggcgctggcggagtttcttgagctggacaaaattaaacgcatggagtgtttcgatatcagtcataccatgggtgagcagaccatcgcctcctgcgtagtgttcgaccagaatggtccgctgcgtgccgattatcgtcgctacaacatcagcggcattacgccgggtgatgactacgccgccatgaatcaggtgctacgccgccgttatggtaaagccattgaagaagataagatcccggatgtgattctgatcgatggcggtaaaggccagctgtctcaggcgaagcaggtcttcgcggaactggatgtgccctgggacaaaagccggccgattttactcggcgtagcgaaaggcagcgatcgtaaagccggactggagacgctgttctttgaagcggaaggtgagggcgtttcgctgccacccgatgcgccagcgctgcatgtgatccagcatattcgtgatgacgctcacaatcatgccatttcaggccaccgtaaaaaacgggccaaagtaaagaacaccagcgcactggaaagcatcgaaggggtggggccgaaacggcgtcagcaactgcttaagtacatggggggcctgcaaccgctgatgaacgcgtcggtggaggagatcgccaatgtacccggtatctcacatgctctggcagaaaaaatatactactcgttgaaacactagcattgaaacggggggggcaatgtaggaacataggctaaattctacctatatccagacagttaccggcatatgcaattaaacattccgacgtgtctcaccctgtttcgagtcgtgctcatcccgttctttgtgctggctttctatctgccgttcacctgggcgccgctggcgactgcactgatttttgtttttgctgccatcaccgactggtttgatggctttctggcgcgccgctggaagcagacgacacgctttggtgcgtttctcgatccggtagcggataaagtgatggtggccattgcgctggtgctggtggcggaatatttccacgcctggtggattacgctgcccgccgccaccatgattgctcgcgagatcattatctctgcgctgcgtgaatggatggcggagattggtaaacgcagcagcgtgtcggtttcctggattggtaaagtgaaaaccactgcccagatgttctcactgtttgccttgctgtggcgtcctgatgcgaccgtcgtggcgattggtgtggtggcgttatacattgctgccgtgctgactttctggtctatgttccagtatttaagcgccgcgcgcggcgatctgctcgaaccgtgatcgatacgatttaaaaagcagcaaacggacgcgctgtgaggataattttattgactcattgcgtcatctaagtagaatgcatcgcatcgaacggcagccaggctgccataagataaataaaatcagcaggttcgacgaaattgctgaattgcgggaatagctcagttggtagagcacgaccttgccaaggtcggggtcgcgagttcgagtctcgtttcccgctccagattcgcaggtcaggttaacctgacggcacatcagtttaaggcgcgttggcagagtggctatgcagcggattgcaaatccgtgtacctcggttcgactccgggacgcgcctccagttacaccctgcccgggtggtgaaatcggtagacacaagggatttaaaatccctcggctgtaaggctgtgcgggttcaagtcccgccccgggcaccatatttctgccgaagaaaatctaataaaataaaagcaatatgcagtaatgtcgtaaccgcccaagggcggtttttttgtgcctgctatctggcggatatggcgactgcaacctccgtttagcggtataagccggcatcagccccgggagctgaataccagctcatcatcagtgtcactcaccagcaccatccgttgcgcctcaccactggaagagacaaaggtcacttcatggccgatgctgatatcatcaaaggcgtcggtcggctgtgactgcttccggatctccagtaccatccgcgaggggtagggtttatcattaaccgtatcaatatgataattggcggtaaaattcagttcgggttgatcaaccacgtaaaattgtcctgacggcatagtcttgacctctgcaaaatgttggccataagtcccggtcggaacaggctgcctgaaacttaaggttagctgaataatcaatgcctacaggcagcagcacctcttttttgatttcatacgacggttgcaaaaatacctgccgcttgcgcttgcctggtcagaaagtcgtactacgcttcttgttcacatagcgcggcttttccaggcacgccattcgggcatggtataaaggtattactgcaactcttaacgggttgacgatgcgggttcaactcctgctgcccggtccctctcctgcatttacgttcatctacgttaacgccagccttatcccttttgggtttctgccgatctatcccaattacatccgatttcactcatttttgcggcctgtgtcgaactctgtaacctgttgaaacgttgtggtttaccgtattgtggtggctattgtttgccgtcgcagagaattaatgccaatgattacacctttcacacctgacttaactgaaccggcggcccccccggttatcggtgttgtcgccagccagttgctcaatccgtatcaacaaaaaatgctggacgaagtgatgcgccagcttaacgcgcgcggtcttatctcggtgctactgagtgccgaaaccgacgtcacactgaccgcactcatccggcaggctacaccactcgggctgcgtggtttgctgttactccccggtaaccgcgttactgatgcctgcaatttgccagtgcttcagattgacgctgagcctgaactgcaggcggatgcactgcgggcgggtgaggtgacagcggaattattgcttaaacaggggcatcagcggtttggctttatgcaggctcagccaggcgaaaactggcgcaaaaacagggctatcgcgcctctctgctggcggcgggcatggcgctgaacgccgaactgactgtggggagtgatgatcgtgactgcgcttatcaggcgatgatgtcttacctgaaaaagacacgtgctgctgagcgtatccaggcactcttctgtgaaagcgatctgatggcctttggtgcaatgcaggcgattcgggattttggtcagggtatccatctggcagtggcaggttttggcgatagtgaagaagcccgcagctcaacctggcatcttaccagctggtcacctgacatccggaagatcgctggtcgcgcgctggatcgctggctgggacagcaggcaggcaacagcagtgctgaagagcaggagcaattacagcggcgtcactctcacgcaggcaaagtgctgccgggtgagatgtcagcctgcggctgcgccttccggcattaaccagcccgcaacgcaggctggcagaataatgtcaggcctgcggttgtcctgccgggccgctgccgccgggtgcgcccaccggctgctgcccgccaggtggtggcggggcatctctgcccggttgcggcggtgcacaggccgtaagcgtggcgaggatagccagtgtggataacagataagcagtacgtttcatcgtaattccccgatcaggtaagcggaacgttgagtatagagaattgcaacaaaaccgcccggacagggctaaatcatcaatacgcatggcaaattgtcgacgattatttgagacgcctcgcaactcgcgcatgctggcaatgcgtttcaggccggagcgcgctaaggtagcgcttcatttaagaggagtcgttatgaatggcatgatgaagttcgtccgcgggtggctggtgttctctgtactgtggggcgtattcatgtggtttatgtcatggcatcagcagggcaaagagcctggtctggcgattctgacaagtctctacgccggtttaatctaccaggcgctgattacgatggttggacgctaccgcgcgcggcggcaacaggctgagtgagttctgctgccggagaggcagcagaactgggtttttagccgaaattaccggtcaggcgctgatggaagtccgtgctgcgtggatccagcccctcaatggtcacctctgcaccataacgctgatagcgatactcaatgccgtccagcgccgcgacgctggacgcatcccagatttgcgcgtgcgttaaatcgatagtgacctttttagggtcatgggcataatcgaaatgctcgaacaggtcgttgctgctggcgaaaaacagcgggccgcgcaccacatagcgcaccgactcgccatcttcgctcagctgacgctccgcatgaataacgtgcgcaatacggcgggcaaacagcagcatagccaggattaccccagccagaacgcccagtgccagattacctgtccagacagtcaccgctaccgtcagcaccataatcagcgtctctgaccacggcatacgtttcagggtagcgggttgcaggctatgccagttaacggttttcacggccaccaccatcatgatcccggccagtaccaccatcgggatttgcgccataatccggctcagtgcggtcaccagtaacagcagcaccagaccggcggtcacggtggaaacccggctgcgcgcccggcccagttcaacattgacgatggtctgacctatcatcgcgcacccggcgataccaccataaaaacccgccagaatattcgccacgcccaggccccaggattcccgacgcttactggagggggtatcggtcaggtcatcgaccagtttggcggtcagcagcgactccatcagcccgacaaaggcgatgctcagggccgtgggccagataatctgcagggtctgcaggttaagtggcaccagcaggctgttaaaaccgggcagaccgggactcatcggcccttcatcgcccacgttcggcatgcgatagcccattaacagcgcgacggcagtcactaccacaatggcaaccagcggtgaaggaacactttttatcagacgcggcaacaacagcacgatagccagtgtgacggcaaagaagatccacaccagtgatgactgtccccagacgtgcggcacctgagcaaagaaaatcagcaccccgagcgcattcacaaatcccagcatcaccgagcgggggatataccgcatcatgcgcgccaggccggccacaccaaacagaatctgaatgacgccgcccatcaccaccgcgggcagaatatattcaacgccatgcagatggaccatcggcccgataaccagcgccactgaacccgcagccgctgttaccatcgccggacgtccgcccagtatcgacagggtcaggcagagcaccaccgaggcgacgaggctgactttagggtctacaccggcaataacggaaaaggagatcacttcagggatcagcgccagcgcggtaatcaccccggccaggcattcgcgggtcagcagcgcaggcgaacgcagaacgcgccctacactgatatcgcccgccacaacgtcggttgcggcaatatcattggtttgagtcataaaagattgcaggctctttagttattttgctcccgcgcgaggggcgggaagatcaggataaacagtgaggggcagatagtaccgggcgactggcgaagataccagaaaaaggcggatgactccttccgtggagtcgatgctacagtgaaaaatcgtccggggttttatggaccaccagttcaagcagctgtcggtagatatccagtaattccctgtcgctttccagctccagccgatgaataagctttgagataatcgctttattgttcactggcatgcctgactgcaaaatttctgcaaccaggatacccagcatctccatctcgctggcgggtttattggcggcaggattaaaataatcagcaatttcctgattggtccggggaagaatatattgcatgtgtaagcccttcagaacagcccgattccggttcggatgtcaggacaaaagcgatcaaaaaaaccaccgcatggacagatgcgatggtaccagtgtcacaaattgaacagaaaaaataacctctgaaggtggaaatccactgacaccttcagaggcgacgcaagtgcatcattcgttacagagtcgcatgacaactcgtggcagtaaacttatacaatgaagcccaatctgtacaatcgtattctttaacaaagtgtgctatttgacacttatcagcagcttataaggactattccgaaacgaaagctgtacaagtaacctgtacaaacggcggggccgaggggcgggaggggaaaaacaggaagccatgaccagcttcccgcaaaaagattagctgaatagcgccagttttgccgtcagctttcgcagggcttttttatcgccgacgatggcgacgcccagcaggcgccactgctgacgcggttgctgtcgcaggacggcgctcagcgcctgataatcggtagtggtctggccctcttccggaaacagcaccagatcgtattcagcctgtttcgcactgttcccgcaatgcactgagctgctcgtcagtcgcggccagcaccggaatgccggtggtgatcaaaccgggagaagggcgcctctcagcatcctccagggtatcgccaaccagcgccggatgtcgctgtcccagggttaatgccatcacggcggcagcattggtggctttgccaggcggcagagcggcattgagtatcattacacagcgtgggtcttgcattgcgcttctcctgactaaaaaaacgcattgtggcaagtggcttaacccaggtctggaagatttgtgcaggcgtgctgataacgggaaggggtaagctggcaggcgcgtttgaaccagcggcccaggtgactctgatcggcgaaacccagcgcggctgccacatcggcgacgggctggccctgcgccagctgacgacgcgcctggctcagccgccactgcaccagccaggcgtggggcggcaaaccccagtgagcctggaacagacgcgataaccggaagcgatccacctgcagatgctgcgccatctgctccagaccgggattatccgcatgatgggcaatcagccagtcacgcgactgcagtgccagccgggcatctttatccgggggctgagcgggcagtgaccactgccggtgcgggatgagctgcccaaacatccggtccagcgccgcctctttgatgatgtcgggatggttgtgccacaaggcatcaaacgcatgccagacggcataagccagtggacgctcgtcgcgcagcgtggcggcaaaacgtagctcacgcagtgagggtttatcagccagcatcggagccaggtgctgcgaaatctgctgcggcgaaagatagagcatccggtaggtaaaaccgctgtcgttgatggcatcaccgtcatgcagctcctccggctccagcataaagaccgtgcctggtcggctctgatgctgtttgcgccgcgaatgaaactgctgtacaccttgctcggtcacgccaatcagataactgtcgtgccagtgaggatcataggcgtgtccggtaaaatgggcgcgtagcgcctcaataccgctgacggcgtcacggcgcagatcgacccagtttgctgatgcctgtttcatgttatccggctcccggttgcggcctctggacattctgccgcgatccactaatttttaacagaccggacgcttttcattggcgtttcgctttgcgtataataacgccatcactcaattagaactcttactattaggctgctaacatttgtctcagcacacgcgtacctttacccacttattgcatctgaccgcacatgcctggcgcctggcggtggatcgtcaccttaaagatagcggcttaagcatgagcagctggatggccatcgggctgattgccagtgagccgcaacgcatgacccagaccgagctggcacagctgctggggctggaagatgccagcatggtaccgctggtggatcggctggtgaaacagtcactgctgatgcgggtacagccgccagaagatcgacgtaagcgtcacctggtgctgactgataagggtaacgaagcgtttcgccaaagtgaaaaccgaggctgacgcactccgtactgaaatgctggccgatattgaccctcaggatctggccgtgaccgagcgcgtattgcaacaactcctgagccgcatgggaagtatgtagcagtggcaaagcgaaatccctacgctgcacgcgagtggttgccgcacgaaaaaccgatgctgccgggatcgccctcgacgccgctgcatccgatgccaaaacgcctggcgtttggcctgatcggtttacttatttcgctgaccggtgcgctgagtaacgcgctggtcacggcgaatctggtcaacctgcaggggacttttggtgcctggtcgaatgagattgcctggctgcctgcggtctatgtgatgggcaacatctctattaacctgctgctggtgaaattccgccagcagtttggcctgcgtgtctttaccgaggcgtttctggtgctgtatgtactggtggcgtttttccatctcttcgccaacgatctcagttcggcaatcattgtgcgcaccgctcacggtatggtggcggcggcgctcagctctctgggcatctactatcaggtacaggcctggcctgcgaaacatcgcctgaaagcgctggtgattggcctgacggtatcgcaactggctatcccgctggcccgcttattctcttcggaattgctgcagctcaacgagtggcgcggtctctatctgtttgaactcggtctggcgctgattgcgctgggcggggtactgctggtgaaactgccaccgggcgatcgcatcaaaacctttgaaaagatggatttcgtcacctttatcctgctggcacccggtatggcgctgctgtgcggcgtactgacgctgggccgtattgagtggtggtttaccacgccctggctcggtatctgtaccgcgatcgccctgacgctgattgtcgctgcgattgtcattgagcataaccggcgcaacccgttgatcaatacccgctggctcagcagcggcatgatggtgcggcttggcattgtgatgatcatgatccgtatcgtactggcggaacagaacaccggcgcaatcggctttctgcagcagattggcttgcagaacgatcagatgcgcggtctggcgctggcgatcatggccggggttattgcgggcatcgccgccagtgcgctgaccatcaagcccaatcatctcaactggccgattgtcacctcgctggtggtgatgattatcgcctcgctgatggatgcgcaatccagtccgctgacccgcgccagcaatatgtatttcagtcagtttctgctgggcttcagcagcgcctttttcatggcacccgcgatgctaatgggcattggcagcgtggtgactcagccgaaaaatctggtgagcttcgtggtgctgtttggcatgagtcagaaccttggcgggctgatcggctcggctattcttggcacgtttcaggtctggcgggaaaaatatcactccagcctgctgggcgatcagctctcactgctcgatcccaacgtcaccgaacggctcagccagtataatgcgctgtttaattcgctggtgggtgacgacgttctgcgcggcgcgcagagcaccagccagttacaggtaatcgccacgctgcaggccaacgtgctcgcttataacgacacctacctgttaaccgctgcgctggcactggtcaccctgatgtgggtgatctggcgtttgacccgtcgtcgttatcttgactggcgccaggcgcaatttaacctgcgtgagcagcaacagctggccgcattacaggaatcaacggagaaacaatgagtcagcaggatgagcttcatgcggcggaacgcgaacgcgcgaatcgccgccgtattctttctatcgccgcaggcagcggcattgtggtgattggtgtactggttattctttatgcctggcaactctggcccttcaccagcgcaatacaaagcaccgagaatgcctatgtgcgcggtcaggtgacctttatcagcccgcaggttaatggctatctcacctcagtcgaggtgatcgatctgcagccagtgaaaaaagggcagttgctgatgacgattgacgaccgtatctatcgccagcgggtgcatcaggcgcaggcgcagctggcgatgaagcaggcggcgctgaacaataacctgcagcagcgtcgcagcgcagaagcgaccatccagagcaataaagcggcactggagaatgccaaagcacaggcgctgaaaagcggcttcgatctgaagcgtgtcgaaaatctcacggcggatggatccctgtcagtgcgtgagcgcgacgccgcccgggccgcagacgcccaggcgcaggcacaggttcgtcaggctgcggcgcagatcgccgtcgcccagcagaatctgcaaaccgtcatcgttaaccgtgacgcactgaaaggcgatgtcgacagcgcccgcgccgcgctggagctggcggaaatcgatctggcgaatacccggattaccgcgcccgatgatggccagctcggccagctggcggtgcgcaccggcgcctatgtcacggcaggtacgcgcctgacctcagtagtgcctaatcacaaatggattatcgcgaatctgaaagagacccagctggcaaatattcgtcctggcctgccggtgacgattcgggtcgatgcgctggatggcaaacgctttacgggtcaggttgaatttatctctccggccgcaggctcagagttcagcgcgatttcgcccgacaacgccaccggtaacttcgttaaaattgcgcagcgcattccggttcgcatccgcatcaatgaccaggatatgcatcagttacgcccgggtatgtcggtcgaagtcaacatcgacaccgccgcacaacccgctggtgagggtgcgccatgatgcggcgcggcttaatggtaagcgcactggcactccttctgaccggctgtgccacgcaggttgaaaaggcaccggcctctctgccgatccctgacgcctggcgcaatagtgtcgggccatctgctgcgccggaggcggagtggtggcgcgcttttcatgatgaaaatctcaaccggctggtgacgcaggcgctgcgcaataaccccgatatcctcacggcgcgatcccgggttgatcagtatcgcgcccagctgcgcgccacgcagggcgataactttccgaccctgagcgccggtgtggccgcgacccgggagcgtacgctctcgtcagtgaccggccagccctatgaaaccgatatttttcagggcttattacaggcgaactacgaggtcgatctctggggagcacgcagcagcagcatcacagcatcgcaggcgagtctagcggcgcagcaggccgctgcgtctgccgccgagctgaccatcgccagttcggtggcgtcaggttatctcaacctgtgcgcgctggatgagcagttacgggtcacggaggcaacgctggcgacccgcaacaattcgctgaagctggcacagcgtcagtttgaaaccggctacacctccaggctggagtggatgcaggccgcctcggaatatcagtcggccaaagcgcagatgcctcagttgcagcaccagatcacccagcaggagaatgcgctgagccttctggtgggtatgaacccgcgcagcatcgcccgtcgtcagcagtttgaccagatttcacctcagcggatgccatcactgctgccatccgagctgctcaatcgccgtccggatattgtgcaggctcagcgccagttactggccgcagatgccagcctggcatcgtcgcgcgctaagctgctgcctgggcttaacctcaccgcgaccggcaccctgcagagttcggtgctgcaccagctcgcggatgatccgttccggctgtggagcgtgggcggcagcatcctggcaccgctgctgaaccgtgaagcgctgacggcgcaggtggatgtctcaatggcgacgcgaaatcaggcactttatggctatgaaaaagtggtgcgcaacgccttctcggaagttaacgatgcaatagacgctatcaggcagcgtgaggcacaacttcaggagctgcaaaagcaggaagcctatgtgacggaagcgctgcgcattgcccgcaatcgctatcagaaacggctacgcctcctatctggatgaactggatgcgcagcgcaccctgttttcaacgcagctgaatcgggtgactgtcaaaaataacctgctgctggcgcagatcgatctctaccgcgcgctgggcggtggctggacacccgcctccacacagtaatccccagaccgatccagccgcagccagagtttctgcggccgggatcggcctctgcgctgtcgcggcgactgcgtatattccccgctttaatcccccaaataaccccctaaaacccatgcatacttctgcttacctgtctttacattcggtggtatcatgcgcgggttttaagccagccagatggaaaagcgcactgaaagcttagcctgcgcgagacggattatccgtttaacttactgatataaaaataaaagaagggattcatcatgaataaaaaaactatttgcacgctggccgtggtcgctgcgttattaaccggctgcgcgcgcactgcaccgattcataacgtgaatcaaacgctcactcagcgttacagcgataaccagatgaaactggcgatcattgaagcgggtattggccggaaatgggtgatgactcccgtttcgcctggcgtgatcaatggtcgtctggcccagcgtgatttcgtggcgactattcgcatcacgtataccagccagaactaccgcatcgattatgtcagcagtgagaacctgaaagcggggcagggcgagatccacaataactacaaccgctggattgccaatctcgatcaggatattcagttacgactctctgctcttgccgctcagtaatgcgtgcgctgtcgcaatgatgtgtcgacagccgatcaaagcataaagatctccggcagccggccgacaaatcagatgagctgctattgctgaaccactgagtaaccctctaccgtgaaggcctgatgcggaatcggcagagggtttcccggacgcactttttttgcagagggccgggatgacgccccgataaacgccgacgccacacatatgacaaaaagagtgttgagatgagactcgcttactcactggtcgactggcaggctctggctccgggattacacgggggcgagggctggcagcactgggcgcaacagggcaacgtcatagaccctaaagaggcgatggcaaagccgcaatttttaccgatgatgacagcacgtcgtctgagcggcggcagtcgtgcggcggtagagtgtgggctggcgctgcttgcgcgtcagcaggttgacgctatcgtgttcaccagtcgtcacggtgaactggaacgtaatctgcgtatcctcacaaccctggccgatcagcagtcaatgtcacccacggattttgccatgtcggttcacaattcggcggtcggcagcctgaccattgcagccaaagcaccactggtctccacctcaatcgccgccggagtcgactcgtttcagcagggattgatcgaagtcagcgcgctgcatcaggcgggttatcagcaggtactgctggtcgatttcgacggcatcgtgcctgactactatctgccgtggctgccggaacagcgtgtgaactttccctatgcggtggcgctgctgctgcgcccgggcgaccagctgtactgcactggccgtgctggcagagatgagagggcagaaacagggttaccgcagagcctgcgctttctgcagcagtggctggcggaatcgcccaccttcagcctgccgggcgaaacgcctgacatggcactgggagagacatcatggctgattgttcacaaccggcgcactacaccggcagccgtatgaactattgctggcggctggtgatgacggcggtgagttttacgctgtttggcataggcgggctgctgctgtcgctgattggcttcaacctgctgctgctggtacagcgcgattcgctgcgccgccgcctcctggcccgacgcgctatcgcctttagcttccgttgctttctgcgattctgccggatgaccggggtctatgactaccggattgaaggcgcagagctgctgcaacaggatcgcggatgcctgattgtcgccaatcatccatcactgatcgactacgtgatgatcgcttcggtactgccagagatggattgtctggttaaagccgatctgcaaaagaacccctttatgcgtggggtgatccgcgccgcggactatctgatcaacagtgaagcggagacgctgttgccggacagccagcagcgactggcgcgcggcgacaatatcctgatctttccggaaggcacccgcacccgctacggtcatccactgactctgcagcgcggggcagccaatattgcggtgcgcgccggatgcgatctgcgtgtggttcacatcacctgtagccagcgtatgctcgataaacagagccgctggtatcagattccgccggttaaaccgctgtttaccgtgcgtgtacaaacgcgaatcgacagtcagtcgttttgtgaaagtaatcccgatgcgcagccgctggccgcgcgtcgcctgacccgccatttacagcaggcgctggtcccccagaacaggtaagacgaaaaccggtatggattcattaattaacgatatcaaacagatgattatcgacacgctgaaccttgaagatctcagtcccgatgatatagagaccgacgctgcactgtttggcgacggactggggctggactcgattgatgcactggaacttggcctggcagtgaaaaatcgctacggcgtggcgctgtccgctgagagtgaaaccctgcgcgcccactttttctctgttgcgacgctggctgcgtttcgtcaaccaacagcgcggctgaaagcggagacaaccttatgatgaacaaagaacagatctatcaggaagtggcttcgctgctgaccagcctgtttgaaattgcgcctgaggatatccatcccaaggcacgtctgtatgaagatctcgaactcgacagcattgatgccgtcgatatggtggttcatctgcaaaaacgtaccggccgtaaaattaaaccggaaaccttccgcgcagtgcgcaccgtgcaggatgtggtggatgccgtggaacaactgatgcgcgaagacgcctgatcccgccgtgcctgctgctacgcttcgcctgctgaatctgcttacgctgctggcctggccactgctggtctggctggcgctgacccagccgcgctggcaggggcttttctggctgctggcgctgctgtttggcctgcgctggctgcagctgcgtcgtcagcaaaacgccatgggcgcggtcatgggctggctggcgctgctcggtgcactgctctgtgtcagcagccagctattacgcactcagcatctgctgctgtggtatccggtggcggtcaatctggcgatgctgctggtgtttggcgcctcactctggagtgcgatgccgctggtggaacgcatcgcccggctgcgtgagcccgtgcttccccctgcggcagtgcgctatacccgccgcgtcacccaaatctggtgcctgttttttatcggcaacggcagcatggcgatctatacctgtttgctgggcgatctgcggctctggacgctgtggaatggcggcataagttatctgctaatcgcagtgctgatgagcgctgaatggctggtacgtcagcgcgtgaggcgaaaagcatgagagtggccgactggctgacgggagacgatcgcgaggttgcctggcgcggcgatcaacgtttgatgctcagcgtgatgcatcgtcaggtcgtggcgctccgccagcgattagcggtacaaccgggcagccactgggcgctctgttttgatgacagttaccgtttttgtgtggcgctgctggcatgctggtatgccagcaaaacgccggtgatgccgggtcactgccgcgccgcgctgctggatgagaggcaggatcggctggatggcgtgctgtgcgacatgccgctggcggtcagcctgccgctgctggcgtgggacgacgcagaagcgcaggggccgctgccgccgctgccggagagtgcagaactggtgctcttcacctcgggatccaccggcgcaccgcgtcaggtagtgaagtcgctggcggtgatggagcaggagagtcgctggctcagcagcctgtgggccgaacagttgcgggggtgccgggtcatcgcctcggtcagccatcagcatctctacggtttatcgtttcgacttttcctgccgatgatgctcaggctgccgtttgccgcccagccgctgttttacggtgaacaactggcccagcttccgcgcgacgttcgctatgcctttatcagcagcccggcctttttatcgcggctggacagcacgctgaaagcgcccgcctgtgaactgattgtctctgccggtggcgcactgcgcgactctgatgcggagcaggtctggcagcgatttggctgtcaggtcagtgaaatctacggcagcaccgaaaccggcattctggcctggcgtcagtgcgtttcgggcggaggcgccgtggcgctgcttcccccaggtcaggctggaacagatgacccccgatcgctggcaggtctggtcgccgctgattactggtgacagcgggctgcagctcgacgatcgactgactatgcagccggacggcggatttcagctggcaggacgccacgatcgcatcgtaaaaatcggtgacaagcgcatctcattaagcgagatagagcgccgtctgaccgacctgccggaaatcgaggatgccgtagcgctggtggtcacgcgtcatgagcgtcaggcgattggcgtcgtgctgtcgctgaacagcgcactggatgaggcggctctgcatcagcacaggcagcagtggaaacgccagctgcagcgctggctggaaccgctggcgatgccgcgctactggcggattgtggccactattccggtgaccacccaaagcaaacgcgcctggccgcaaatagaggaactttttcatgttgccgattgaacgcagccgggagctgcgggctgacagcgtcacgctgaccctgcagatagatgccggactcttctggtttcagggccactttccgcatctgcccattctgccgggtgtggctcagctcgactgggtgatgcactacggcgtatcactgcttgcgcccggtaaacagtttgccgccgttgataacattaaatttcagcagccggtattacccgactcgctattgcaactgcatctggactgggacgctgaaaaatcccgcctgagtttccgttacagcctgctgaagaacgacggcgagcagattgccagcagcgggaagatcgcgctgtgttaagcgccccgttttcaccctgcgtggtgatcccctgctacaaccacggcgcgatgatggcgtcagtgctggcacggctggcaccctttaatctgccggtaatcgtggtggatgatggcagcgatgcggccactcagcttcagctggcgacgctgcacgccccgcagctcagcctgctgcgactcgacagcaatcagggtaaaggcgcggcggtgatccacggtctgcgggctgcggcggcacgcggcttcacccatgcggtgcagctcgacgcggacggccagcatcaggcggaagatctgccgctgatgctggcggaagcggagcgttatcccgacgcgctgatctccggtcagccgctctatgacgactcgatccccaaatcacgcctttacggtcgctacatcacccacttctgggtctggattgaaacgctgtcgctgtcgatccgcgacagcatgtgcggcttccgcgtctatcccctggccgcgacgctggcgctgtgcgatcgccgggccatcggtcagcgcatggattttgacaccgagatcatggtgcggctctactggcagggaacccgcagtcgctttatcccgacccgcgtcacctatccggccagcgggctgtcacacttcgatgcgctctacgacaacctgcgcatctcctggatgcatacccggctgtttttcggcatgctgccgcgcattcctcgtctgctggcgatgcgtaaaccgccaacgcactggtctgcggaaacggagcggcgcggacagtggggattacgttttatgctggcggtctatcgctacggcgggcggctgccctttacgctgctactctggccggtagtggcggtctactggctgagcggtcagcgcgcgcgacgcgcttcccgtcagtggctggcgcaggtcactaccgccgcgcagcagcagcagattgcgttaccgccacggcttaacagctaccgccatttcctgcggtttcgccggggcaatgctggataaagtggccagctggcgcggcgatctgcgctggggacgtgatatcgattttgcgccaggcgcagaagcggtgatccgcacacccacgccgcagggcaagctgattctcgcttcccatcttggtgacattgaagcctgtcgcgcgatggcgcagcaggtcagcgggctggtgattaatgcgctggtgtttaccgacaacgcccggcgttttcgggcggtgctggaaaccattgccccgcaggcgggggtgaatctgatgccggtgagcgatatcgggccggagaccgctatcatgctgcaacagaagctggatgcgggcgaatgggtggcgattgtcggggatcgcaccgcggtcaatccgcagcgcggcggcgagcggcgggtgatctggagcgactttctgggccgcgaagcgccctttccacaggggccgtttgtactggcggccgcgttgcgctgtccggtgctgctgatgttcgccctgcagcaacagggtaaactgcgtattcactgtgagcccttcgccgatccgctgctgctgccgcgtgcgcaacgtcagcaggcactgcaacaggcggtcgatcgttacgcagcgcggctggcccattacgcactgctggcgccgctcgactggtttaactttttcgatttctggacgctgcctgatcaacaggcgcaccacaaggagtctgaccatgactgaacatcatgctgaagtcgtgctgaccgtctcattccacgactgcgatcccatgggcgtggtctggcacggcaactatttccgctttttcgaagtggcgcgtgaagccctgctgcgcagcattaactacagctatggcgagatggccgccagcggctacgtctggccggtggtcgatacccgggtcaaataccgccagccactgcgctgcgaagagacgattcgcgtcagcgcccggattacggaatatgagaaccgtctgcgcatcgactatgaagtgcgaaatgctgccggtcagatcaccaccaaagcgcatactctgcaggtggcggtggagcaggagagtcaggcgttgtgctttgtttcacccgatattttactggaacgtttaggagtgaaaggatgctgaaaattgtgcttaccagcctgctgctgtgggccagtgccgccagcgcggtcacgctggatcagctgcagcagcgttttgccagccagccggtgattcgggcagactttatccagacgcgtaccatttccggcatgcgtcagccgctggtctcgcacgggcagatgctgatcgctcgcgagcagggcttatggtggcatcagcagacaccctttgtgatgacgctgctgctggatgataaacgcatggtgcagagccttagcggccagaagcctcaggtgatcaccgccgacagtaacccgcagatgttccagttcaaccatctcttgcgggcgctgttccaggccgaccagaaagtgctgaacgagaacttcagcgtggccttcagcgatcgcggcaacggagcctggacgctggagctgacgcccaaagcggcgccgctcaacaaaatcttcaaccgtatctcgctggcgggcagcgcctacctggacagcatcaacctggatgataaacagggcgataaaacgcaaatagagctcagcaacacccgaattgaaccgccgcagttaagcgacgaggagcaggcgcgttttgccgggccgtaacgatcggctgctggccctcctgtggctggccctctgtctgctgctggcggctgcgctctcttttttgctgccgcgtagtcagctcaacagcagcgtgctggcgctgctgccgcagcagaatctgggggcggcaccgcctgcgctgcagcagggctttatgcagcggctggatcgccagctggtgtggctggtttcacccggtgagcaggacgatccccaggtcgccgcctggtggctggcccagctgcgcgcgctgcctgacctgaaacaggtgcagggtgatctcgacgggcaacagcagcagcagtggggccgctttgcctggcaacaccgtaacggcctgatcgatgaggtgacgcgcgaccgcttacagaaacggcggcgaggcgcaggctgactggctgctggcgcagctcttttcggccttctctggcgtcagcagcaaagagttgcagggcgatcccatgatgctggtgcggggttcgcagctggcgctggcacaaaacgccgggcgcatgacgctgcatgatggctggctgacagtaaaagatgcacagggtcagcagtggtattttctgcatggcgaactggcgaacaacgccttcagtatgcagcaaagtcattcgctggttacccgactcagcgcgctggagcaacagcttaaaagccgctggccgcaggcgaaactgctgacgcgtggcacggtgctgttcagcgacaacgccagccagcgtgcgcagcatgacgttaaaacgctgggcagtgtgacgctgggtggcgttgtcctgctggtgctgctggtcttccgctcactgcgcccgctgttgctgacggtcacgtctgtggccatcggcgcgatggcgggcacggtgatgacgctgctttgcttcggtgaactgcatctgatgacgctggtgatgagcctgagtattgtcggcatctctgcggattacacgctctattatctcaccgagcgcatggttcacggcgatcagcagacgccgtggcagagcctgcgaaaagtccgcggcacgctgctgctggcgctcgggaccaccgccatcgcctggctgctgatgctgctggcaccgttcccggggctgcggcagctggcggtgtttgccgccagcggattaacggcctcctgtctgacggtgattctcatctatccgtggctggtacgcggattaccggtgcgtccggtgccgctgatggtgccgctggcgcgctggcttgccgcctggcgtcgccagcgcgggctgcgcgtcggattaccggtggcgatggcgatcttcgcgctggccggtatcgcccagttaaaggtggatgatgacatcgctcatctgcaaagtgcgcctgcgcatctgctggagcaggatcgccagctggcaaccctgaccggacagcgcgccgatcagacctggtttgtggtctggggcgatgatgcacagcagacgctgcagcggctggaaaaactggcaccggatctgcaccaggcgcagcagcagggctggctgcagcactatcgtctgctgccgctgacgtcgctggcgcagcaacagcgggatcttcagctgttgaaacaggcagcaccggatattacggcccgcctgcagcaggcgggtatcacgctgccggcaccggatctgaccccgatgccggtaacaccagaggcgtggctgtcgagtccgctgagtgaaggctggcgactgctgtggctgacgctgccagacgggcgcagcggtgttttgatccccaccagcggcgtaaaaaacagcgctgcactcgcggagctgaccaaacagcatccgggcgtcagctggattgaccgcaaatcaggttacgattcgctgttcagcttctggcgcaccctgctgagcgggttactggcgctggcgctgctgctgatcaccctgagttttgtcctgcgactggggttaaaggcgggcttacgcagcgcgctgccgtcagtgctgtcgctggcgatggcgctggcaacgctgggctggatcggtgcgtcgctgaatctgtttgcgctgctggcactgattctggtgctgggcatcggcattaattacacgctctttttcagcaacccgcagggtacgccgctgacctcgttgctggcggtgtcgctggcgatgattaccaccttactgacgctgggtatgctggtattcagcagcaccagcgcgattgccagttttggcacagtgttatgcagcggcatcttcagcgctttcctgctgtcgccgctggcgatgcgacccacccgatcaaggagtaaacgatgattcgcgccgctcttattctgctgacggctctgctgctcagcgcctgtgccggacctgcacccgacagcagccgtcccaccgcctggctgaaaccgggcgtgaaggtgacgctgccaccgccgggcatccgtcccgccttccagcagcagcagttgctgaccggacaggtgaaaggccagagtcagtcactgctggtgctgctcagcgccgatgaacagcaaattgatctggccggactctcctcggtgggtattcgcctgttcagcctgcgctacgatgccagcggtattcacacccagcagctgatgccgctgccgcagatgccgcctgccagtcaggtgctggcggatattatgctcagctactggccacgggagctgtggcaaaaacagctgccaccaggctggacgttgcaggatcaggggttaaagcgacggctgatcgatgccgataaccagctggttaccgaaatcgattatctgcaacgcggtaatcagcgccagcccatcagcattcagcagcatgcgtttggctatcagatccgcattcaacatctggacggctcatgatttacatctctgccatcggcatgctgaatgccctggggaataacactcagcagattgcggccagtcttaccaggggtgaggcacccggcatgcagctgcgtcatggctggctgagcggcgaccgcgcctgctggcttggcagggttgaaggcgatttgccatcgattcctgctgccctgagcgcgcataacacccgtaataaccagctgctgctggccgcactggcgcaaatccgtccggcgctcgacgcggcgattgcgcactatggtgccagcagagtggcagttgtgctgggaaccagcacctcgggcgtggatgagggcgatcagcagattggcggcagtcagtccggttatcactatcagatgcaggagctgggcgatccctcccgtttcctggctcactatctgcgcctggatggcccggcctataccatttcaaccgcctgctcctccagcgcccgcgccattatcagtggtgagcggctgatcgcggcagggctggtggatgtggcgctggtgggcggtgcggactcgctgagccggatgccgatcaacggattcgacagcctggagtcgctctctgaacgtcgctgcgctcccttcagccgcgatcgcgacggtatctcgattggcgaaggggccgcactgatgctgctgacgcgggaaccgcagccgctggcgctactgggagctggcgaatcgtctgacgcctggcacatgtccgctccccatccgcagggcgagggcgctgaacgggcgatgcgtatggcgctgcaacaggcgaatctgttgccagagcaggtgggttatatcaatctgcacggcactgcaacgccgcttaacgaccagatggaagccgccgtgattcagcgcctgtttggcaatgcagtgccgtgcagctcgaccaaacatctgaccggccatacgctcggcgcggcgggagtgtgtgaagccgccctcagtgcgctgatcctgcaaaacaatctgccgctgcccgcgcaggatttcagtgagatggcggcggatgagacgctgccggattgcggattgttattacagccgcaggcgctgcaacggccggtcatcgcctctaactcttttgcctttggcggcaataacacctgtctgattctgggacgccaacatggttattaattctcccgcggcacgctggctgccgcacgctgcgccgatgctgctgcttgatcagctgatcgccgtggatgatgagcaggtccactgtcaggtgtcgacctgcgccggtggcgtactgacaccgtttctgacgcctcagggtgaactgcccgcctggtttggcgtcgagatgatggcgcaaaccgtgggcgtctggtcgggctggcatgcaaagcagggcggcgccacccttatcccgcccggcatgctgctgggcggacgcggctggcgggcagagcgatccctctttcccgccagtgttacgctggatatcagaatgacgctgctgatgcgcgatgaccgcatgggcagctttgagggcgacattcattacggcacccagcggcttgccagcggtcgtctgaatacgtatcaacccaatgaagcagaattacagcaattgatgtcacaaggaaatcagccatgacagattcggtattagtgacgggcgccagtaaagggattggccgcgcgattgcgttgcgtctcgcccaggatggctatcaggttatcgtccacttcaaccgtgaccgcgcaggcgctgagcagtgcctgcagcagatcgaaaccgcaggcggcagcggccgtatgctgggatttgatgtggccgatcgggcggcaacccgcgctgcgctggaggcggatattgagcaatatggcgcctattatggtgtggtgagcaacgccggtatcacccgcgatgcggcgtttcccgccctgacggatcaggagtgggacagcgtcatccacaccaatctcgacagtttttacaatgtgatccagccctgcgtgatgccgatgatcggtctgcggcgcggcggccgcattatcacgctctcgtcggtgtcggggataatgggtaatcgcggtcaggtgaactacagcgcggcgaaagcgggcattattggtgccactaaggcgctggcgattgagctggcgaaacgcaaaatcaccgttaactgcattgcgccaggcctgattgataccggtatggaggggctggaacctcaggtgattgaggaagcgatgaagatcgtgccgatgaagcgcatgggcgcggctgaagaggtcgccggactggcgagctatctgatgtccgatatcgcaggctacgtgacgcgtcaggtcatttctattaacggaggcatgctgtgatccagcgggtagtcgtaaccggcatgggcggcgtaaccgcctttggtgagtcctgggctgaggtttcggcacggatccgtgcgggccgcaatgcggtgcgctttatgccggagtggcagatctacgacgggctgcatacgctgctcggcgcaccggtggatgactttgtgctgccggcgcactacacccgcaagcgcatccgcgccatgggccgcgtttcgctgctggcaacgcgcgcgaccgagctggcgctgacccaggcgggcctgattgaccatccggtgctgaccagcggagaaacgggtatcgcctacggttcttccaccggcagcaccgggccggtcagcgagtttcgccaccatgctgaccgaaaagcacaccaacaatatcaccggcaccacctatgtgcagatgatgccgcataccacggccgtcaatgccggactctttttcggcctgcgcggccgggtgatcccgacctccagcgcctgtacctctggcagccaggcgattggctatgcctgggaagcgattcgtcacgggtatcagacggtgatggtggctggcggcgcagaagagctctgtccgtcggaagccgcggtgttcgacaccctgtttgccaccagccagcgtaatgacgcgccgcacaccacacctgcaccttttgatcagcagcgcgatggtctggtaattggcgaaggggcgggcacgctgatccttgagtcgctggaacatgccctggcacgcggtgtaacgatctacgcagagatcaccggttttcataccaactgcgacgccgcccatattactcagccgcagcgagaaaccatgcagatttgcatcgagcgggcgttgcaaagcgccggtatcacggccgcagacgttggttatgtgaatgcgcacggcaccgccactgaacggggtgatatggccgaaagtctggcgacggcggcggtgtttggcgaaacgacgccgatctcttcgctgaagtcctattttggccatacgctgggtgcctgtggggcgctggaagcctggatgagcattgagatgatgcgggaagggtggtttgcgccaaccctgaacctgacgcaaccggcagcagatggcggccagctggattacatcatgggtgagccgcgtgagattgaaaccgactatatccagagcaacaactttgcctttggtggcattaacacttcattgatcttcaaacgctggcgcggcgtctgatctcaggcccgtgccgcgctggcacgggccagtttatttttcggacgaaagaaccggacgataatcagcctttcatctacactgtcactcaccgcatcactcccggcggcccatgtttttcacaggatagttatgtctttacccttgccacccgacgatcacgatgagccaattcgccagtcacttgacgatgcgcactttgcgatagtggtgcttgcggtgacctcggtaacgcttataatctttgtcctgatgattacgctctggatgagctgacacgcacagggattcaacggattgaataaggagaaggcgatggactccggagatgacaaattaatcgcaattatcggtttgctggcggcctgcctgatcggggtgaccttcctgtttaccatggtctggctgaccgacgtacgtcatcctgccgatccctctctcgacgttcgctcctgttaccctaaaaagccaccttctcagcacgtctgatttcgtgtcgcaaacttaatctgctgactgcgcaataccagcgccagcggctcatgcagattacggttgccattgggatcggctaatcccagcagcgggccaggggaacgccggtcatcggcccaggccggatactccaccaccggatagagcgaaatcccctccaccgcaatgccctgatccagcgccaccgccacattttcactgatctcctgcagccagggggcgcgcgcttcaccctcagcgccagtttcagcaatcagcatcggacgctggtagcgctgccagcactgcgccagcagaatatgcagcggcacacgctccggatcctccagcgacatcggctggtcggggaaaaaccagtggttatcgggatagtagttcaggccgaggatatccaggcaatcttcactgccgcctagctccttatcgacgcgaccggccagcatgtcccaggcttcgaactgcgcctgatgctgcgcatcggcatagggtttgctgtccggattatcaggatgatgagcgatctgcaccagcgggtcagtcagcacaaagcgcgcctccggatagacctcgcgaatggcatgtatcgccgccagcgaggcgcgaaccagctggcgcttcagctctttaccacgctgcgccgcatgaggattaaaccaggccacatccgccccggcccatgaccagaatgagatttgattaaccggtgtaaagaaggggcgttcgatgccctgatcgcgcatcagttgtgccatcgcgcgagcgaaacgactaaaatggtcaacaaattcggctttccagatattaagatgatcgggataaccgaaatgagccagctcccagatgatctccatctgctgacgtcgcgcggcgtcgaccatcggcagaaagctctgccagtcatactggccagggatcttttcgatcagatgccagcgcgcaccgtcgcgggcggtgagcagatgctgctcagccagggcggcataatctttttccagcagcatatcgtgtccgctgctgatcaccatatccagccgtttaccgggcgtacggcaggcagtggaacaggggaaactgccctggaaaaagctgcgaaacaggctgggatgatagcgctggcgggcatctgtaagggattgatgagacatattcctctcctgccgggataataccggtcacagatcgtccggttaagtctagactaaaaaacgcccgtgacccctaactaactcagaacagaggaatagcatcagaggtcggaccggggaataataaaaataactgcattttacagggaaatgtcatgaccgaagcgtttgagctctcccagccattggaacggtccagctggctggaaacacagctggagccagagtgtctgcgccatccgggtctgagcggcgtccatcagctgagcgacgggctggatgcttttgctgcccgctatctgctgatgcaaaaagcggagcgttcactcgatatccagtattacatctggcaaaacgatctctctggccggttgctgttcagcgccgtgctggaagctgcccgacgcggggtgaaagtgcggctgctgctggatgacaacaatacgcctggcctggacgacacgctggcccagctcaaccgccatcccaacattgaggtgcggctgtttaatccattctcgtttcgcaccctgcgcgcgctgggttatctcaccgactttgcccgtctgaaccgccgcatgcacaacaaaagctttacggtggatggcgtcacgaccgtggtcggtgggcgcaatatcggcgacgaatatttcggcactggcaatgaaccgctgtttgccgatctcgacgtcatggcaataggcccggtggttaaagaagtcgcagaggattttgagcgctactggcgcagcaagccggtctctccgctgcagcaggtgctggatgaagaggagccggaagaggacagtgtgagtctgccagcagagtggcgtcacagtgaaccggtgcagcgctatcttcagcggctggaaaattcttcgctgctgcaggagctggaagagggcacgctggctctgacctgggcaaaagcgcgcctgctgagcgatgatccgcgtaaagggctgggcaaagcgcgtgccagaagcctgctgccgcagcgaatgctggaggtgataggcacgccgcaaaagcagttcgacatcatctcggcctatttcgtgccgacccgcgcaggggtcgctcagctgctgtcgctgaagcgcaaaggggtaaaaattgccattctgaccaattcgctggcggctaacgatgtgtcgattgtccatgccggctacgctaagtggcgcaaaaaactgctgcgtcatggtattgcgctctatgagctgaaaccgcaggcgggcgtgcctgatgccccgcacgaccggggattaaccggtaactccggctccagcctgcatgccaaaaccttctcagtggatcaacagacgctgtttatcggctcgtttaacttcgatccccgttcagcggtgctgaatacggaaatgggactggtgattgagagtgcggcgctcgccggagagacgcatcagcgtttcagccagtcaatgcgcgatcgggcatggacgctgcggctggataagtggggcagggtaaactggctggagtatccgggtgagccgcagcagattgtgcataaacacgagccgggctgctcctggtggcaacggctgcaggtgcggttagtgtggcggttgccgattgagtggctgctttaagctggaccttgcctgggtacaggcgctggctcaggaagcatacgccctccgcaaagacgcaaaacccgccatccctggcgggctcagcgcgggcgattacgcacctcatccctgaggtgcgcccgttgccgggccaacgcgttgctttgttcaaaaacgctcccggcgtttttgtccctggcccgctatgctttgctactggcgtatgctcccatcgctttaaactcttaagctgtctgtgagacacatcatttatagcctgacctcacttatggcccgaggtcactgatcgcctgtcattgtgcttgtttacgctcaaatttccccgagaaacaggaaccgcagcagcggaatgcgcaggtgaatctcatacagcagaaacgcgatgccaaacaccatcagcaggccaacgaagaagcccagcgtgttattttcaatccgtggcgtcacgtaaatgccatacagcagcgtcagcggatggtgcaccagatagataaacagtgacgcattgaccagatacataatgcgcggcgaatgtgaattcagcagcttatgaccaaagcagaagcagacgttcagcatgcaaatgcccatcagcgtcgagataatcgcatccagctcatacaaccagccctcaccgctgctcagtcgctggttggcgcaataggccgcaaacatcagcagcgcaccgacccacatcaccagattgaagcggacaaacagctgcttcagcgggggatgtttccacgccagcgctcccagcataaagaacggcagatagaagagtgtctgcatcactatgatgctaaacaaaccatccatcagccacgcaggctggaaaataaacaccagacgccggaacacacaccagagcagcgcccacgccagtacgcccgccgtcagcgatccccagccaacccgcgaataatcaatggtgcgatgctgatcgcgcagccagcggaaggtcaccatccccagcgtggtcagcatcaccagcaccaccaggaaccacaggtgtgaaatcagctcccacatcaggttattaaacttctgatagggcgtgaaacggggccagtcagccagcttatccgtccactctttcagcataaaaaattgcggcagcgtcagcagcggaatggcggtcagcattgggatacctacccgttccagacgcaccttcaggaagcgacgtggctgatagcgcagataaagcatgtaggagaaatagcccgaaatgacgaaaaacacctgcatacgaaacgcatgaataaaatcattcagcagcgtcagccacaacgacgcttcatgactgtttactgcccatttctgcgcggagtagatgagggaaacgtgaaacggcacccccagtaacatcagataggcgcggatggagtcgaggaagtattcacgttcaggttttacagtactcataaagttccagttcgttagtacgtttaaccggtttcaccctgaaaccggattatgctctgtgaaaattctacctgggataaaccaggtatactatcagtggaatccgtagtgtctaattgtcctaaaagcagggttaagcctgacgaaatgcgggaacaatgttgcgcataagctgtcggaaaaccgaataatcctttaagataaacgggtttgatttaagcacacgaaagggggggatgtgctgactaaagaaaaaaataaagccggactgatgaaggtacgctggattggtactgcagttctgctggcgttgtacgccaataacagttgggcgtttaacatcgacgatgttgccaaacaagccaaagcgttggcagggaaaagcttcgaagcgcctaaaagcaatttaccctctcaatttcgtgaaatgaaatttgctgattatcagcagatccagtttaaccacgataaagcgtattggggcaaactgcgcacgccgttcaagctggagttttatcatcagggaatgtatttcgataccccggtgcagatcaacgaagtgaccgccagcgcggtgcgcgagattaaatacaaccccgattattttaatttcggtaatgtaaaacatgacgcagatgcggtaaaaaacctcggttttgccggtttcaaagtactttacccactcaacaacaagggtaaaaacgatgagatcgccagcttcctgggcgcgagctatttccgtgtcatcggtgccggtcaggtttatggcctgtcggcgcgtggacttgccatcgatacggcgctgccgtccggtgaagagttcccgcgctttaaagagttctggattcagcgtcctaaaccacaggacaaacagctggtgatctacgcactgctcgattcgccgcgtgcggcgggtgcgtatcgctttgtgctgcatccgggtgacgcttcaacggttgatgtgcagtcaaaagtttacctgcgtgataacgtcggcaaactgggtgttgcaccgctgaccagtatgttcctgtttggtcagaaccagccatcgacggtgaacaacttccgtccggcactgcacgactctgacggtctctctatccacaatggcaacggggagtggatttggcgtccgctgaacaacccgcgtcatctggcagtgagcaccttcaccatcgagaatccgaaagggtttggtctgctgcagcgtgggcgtgactttaacaactatcaggatcttgatgaccgctatgatcttcgtccaagcggctgggttgagccaataggcgactggggtaaaggccgggttgaactggttgaaatcccgacggcagatgaaaccaacgacaacatcgttgcgtttctggacgccggagacactgccagagcctggcaaagagatgaacttcaaatatcgtctgcacttctcgcgcgacgaaaaccagctgcactccgatgataccgcctgggtcaaaaataccctgcgttcagcgggtgacgtgaagcagtctaatctggtgcgtcagccggatggcaccgtggctttcaccatcgacttcgtgggtaaagacatgagcaagatggcggaaaacagtcaggtggcaccgcaggtcagcgtgggtaaaaatgctgatgtggttgagcagagcgtacgttataacccggtcaccaaaggctggcgtctggtgttgcgtctgcgtgtgaaagatgccaagcagtccaccgaaatgcgtgcggccttggttagcggcgacaagacattgacggaaacctggagctatcagttacctgccaatgaataaatcgacttttacacctcaacgttatgtggaatctctgccgctggatgcggcagggaaggcccgactgagcgtctcattgcagaatgccagcgagttccacttcatccatgatgtgctgggcagggatgtcgcagccagtgaccgtcccgacgatgcgccgttaaaatcggtctcatcgcgggttgaaatggcctggcccgattcgctggccgaaggtcagcagttgggtaaagattacctcgaccgcaccacgctgaaggcgatgccaaaggtcaaacgctcactgatgttcccggaagcctggcgtaccaacccggtcgcccgtgcctgggactcactgcgtggacacaaatcggtgccgcgttatagcaatgcggaggagcggcgtgccgaggagaagtggcgtcatgtcggttcgattcgacgctacattctgctgatcctgaccattttccagaccgtggtcgccacctggtacatgaagagtattctgccgtatcagggctggacgcttctggatccgatggagatgatcaatcagaaactggcagcagtcagtgatgcagatcctgccttatttgttgcagaccggcatcctgttcctgttcgccatactcttctgctgggtctctgccggtttctggacggccctgatgggcttcctgcagctgcttattggacgtgataaatacagtatctcttactcaacggtcggagatgaaccgcttaacccggaacatcgtaccgcgctgattatgccgatctgtaacgaagacgttgagcgtgtttacgccggtctgcgtgcgacctgggagtcggtggttcgtaccggtaacgctgaacacttcgacgtctacatcctcagcgacagttacgatgcggatatcgcgattgccgaacagaaagcctggatggaactggtgcgggatgttggcggggcaggcaagattttctatcgccgtcgtcgtcgtcgcgtgaagcgtaaaagcggaaacatcgatgacttctgccgtcgctggggcagcaactacagctacatggtggtgctggatgccgatagcgtcatgagcggagagtgtctcaccggtctggtacgcatgatggatgccaacccgaatgccgggatcatccagtcgtcgccgaaagcatcgggtatggatacgctttatgcgcgctgtcagcagtttgcgacccgcgtctacggtccgttatttaccgccggtctgcacttctggcagctgggcgagtctcactactggggtcacaacgccattatccgcgtgaaaccctttattgagcactgtgccctggcaccgttaccgggagagggctcctttgcgggttcaatcatgtcgcatgacttcgtagaagctgcgctgatgcgtcgtgccggttggggcgtctggattgcctatgacctgccgggatcctatgaagaactgccaccgaacctgctggatgagctgaaacgtgaccgccgctggtgtcacggcaacctgatgaacttccgcctgtttcctggtgaaagggatgcacccggtacaccgtgcggtgttcctgacgggtgtgatgtcctacctctcggctccgctatggtttatgttcctggcgctctccactgccctgcaggtagtgcatacgctgatggaaccgacctacttcctgcaaccgcggcagctcttcccggtctggccgcagtggcgtccggagctggcgatagcgctgttctcgaccaccatggtgctgctgttcctgccgaaaatgctgagtgtcgtgttgatctggtttaaaggatcgaaggcctacggcggacctctgcggctgctggcttcactggtgctggaaacgctgttctcggtgctgctggcaccagtgcgtatgctgttccatacggtgtttgtggtcagcgccttcctcggctgggaagtggtgtggaactcaccgcagcgtgatgacgatgcaacaccgtggagcgaggcgtttaaacgtcacggttcgcagatggcattgggtctggtgtgggcgattggtatgggactgctggatcttaacttcctgtggtggctggcaccgatcgtgttctcactgattctgtcgccgtttgtctcggtcatgtcgagccgcgcaacgctgggcattaagagcaagaaagcgaagctgttcctgatcccggaagagtactcgccgccgcaggagctggtggataccgatcgctatgtggtgctgaaccgtgagcgcgcgctggaaaatggctttatgcatgccttattccatcctgctttcaacgcgctggcaacggcactggccacatcgcgccacaagcagagtcagttactggactatgcgcgtgaccgtcgggttgatcaggcgctgagcgatgcgccggataaactgggccgcgaacagcgtctgcagttgatcagcgatccggtggtgctggcccgtgttcatacccgactgtgggaagatgcggacaagtatcatcagtgggttgagagttatcaaaaactcacgctcaaccccaacgcgctggcaaacaacgcgtaatctgaaaaagcggcagcgatgccgctttttttatcggattaaaacagcgattcgctgataaatttattgctggcagtcaccgcgagcagcgcgtgacgatctcaatggctgtttcttcatggcggatatgtgtggtgaaagggtgcttaaaggcgggtgttatcgtcgcggctgtgctctgcttaagcggatgcggcagtattatcagccgtaccattccagggcaggggcacggtaatcagtactatcccggcgtacagtgggatgttcgcgacagcggatggcgggtcctgacgatcctcgacctgccgctgtcgctggtggttgataccctgttgttaccggtggatgccagccacggtccttacgagtaactgcgatcggaatcgctgttatcatcttcccactcttgcgcggcggcttcaccctcttcggtgtccagcggcggctccagctggaactcgccgtcatcccactcgtgcagggtattttctgctaaccactcctgacgtagttcaacttcgtcaaaatctgcatcaaaaatggcctgtgccgcttcaccgctacggtaaggcagacattcgcctgcttcaccttcttctgccatgaattcagcctgccacatgatatcgccatcctgcatcacatacttttgcagaccaaactggctgattgatgcatccccttcctcgagctccgggtggttagcgaggaaactcttcacgtgcagcatcgatggcttcctctaaggtactgtacatgctcatcgctcttctccttcacgggtctttgactatggatttatttgatttcagtgaaggatagacgaaatctgaaggagggaaaggtcaggccggtgcaactggcgggaaataagccatttcccgccagtcagggtcagatcatcttttgcgggaaatgcaaaacaggttgaacggactcatgaatcacgggggctgagtagcggatacaacattttatacatggcttaactttcttaaaattaattctggcgatggagagggcctgactcagattatataacgtgccgataaatatgacctcttctttatcaggcatacgcttgcaccctttacgatgaagaaagtgataattttcctgatcggtaccgattgtaacgtaatagtagagacctttgttcatattaactgtcccattagaggtttgctgtgttgtcttttttataattctggccagagccgttaaaggcctgactgttacaaaagaaactaccgataagcattaatgagttcaaattccataatggtctatcggggtgttaaaaaaatgtaaaatggaatataagctaaatcagcaaggcaatcgcttgtaaaataagttaatttttatcgattcataagcggtgagacaccgttaagaccggctaaataggattaggcctggcgtgcagaataatcagcgccataacagatttaatagcactcgctgcaatattaattaataaatagcgaaacaggctgaatgccgcctgccgtcctgttaattgattagcttttttaaatttaaacagagacaaattatattatgaatataggtgtttattaattactggacctgcggtttcgcttacaggctgagtcagccatgagtgatttatttagcaggggagtaaaacgcgctaaatgcctgacagacatttagcgcgaacagattaataacgggagggtttcgccctcggggcgcgttttaaagcggcggtggagccacatatactgttcaggtgccagcagcacaccctcttcaacaacctgattcattctggttgcggttgcgacatcactttccagcgtaaattcgccgctgatgtcaggcagtatcatcagttcatagccacgacccccaggcagacgacgcggtacgaaagggatgacagccggtttaccggtgcggatcagcagatgagtgcccaccgttgtggctgctttttccacgccaaagaaggggacaaagacgctgctgcgcgggccataatcgtggtcgggcgcataccagataatgtcaccctgtttcagtgcgcggatcattcctttgagatctttacgatcgagcatgcttttattcgaccgcattcgacctttgacctgaagccagtcgatcagtttgttgtcattcgggcgatagacgccaatgccagggttatggataccaaacatgcgtgcaccaatctccagcgtcagaaagtgcatgccgataagcagcacgccgcgctggctatcgcgcgcctgctgaatatgctccagccctgaaggcgtatgccatttattgatgcgccagtcaggccagaaccacgccataccggtctcaattaatcccatgccgaccgattcgaaattgtgtttaaccatcgcttcgcgttcatttaccggcatatccggaaaacttaattccagattacgccgggaaatactgacgcggtgtttcataaaacgcatcccaatgcggccaatattacagccgagaacataaagcaggggataaggaagtagcaccaaaagataaagagaagcgacacccagccaggtcagccaatagcgcgggtgaagcagttctcgtgaaaactgaggcaactgagtcatgtgaaggttaattttcctgcgtcgcgcaccgtgcggtgctgatatctcgttgatttacaccattgtgccagtttttgacgtgcgcttaaatatcactatcggaacgtgccatcaatgaacaaaggttaatagtccaatgttgctggaaaaaacggcaacaggcgatcaatctggtcactggcctttgcatcccggtgaaatcaggtatcatgtgcgcgctaaatttcttctattgataacaggacgaacaccatgccagtgttacataacctcgtttccaataaagagctgaaggcgcgcatgctggctgaaaccgagccgcgcaccactgtctctttttataaatatttccagattgccgatcccaaagcattccgtgacgcgctctatcttggcctgacagctcttaaggtctttggtcgcgtctacgtggcccacgaaggcatcaatgcgcagatcagcgtgccagccagccagtatgaaaagatgaaagaatggctgtatggctttgatccggcgctgaacaacctgcggatgaatattgcgctggatgatgatggtaaatcgttctgggtgctgcgtctgaaagtgcgcgaccgcattgtcgcggacggtattgaagacgacagttttgatgccagcgatgtgggtcagtatcttaaagcggcggacgtaaacgccatgctggacgatcctgacgccctgtttcgtggatatgcgtaaccactacgaatatgaagtgggtcgctttgataatgcgctggaagtgcctgctgacaccttccgcgatcagctgccgatggcggttgagatgctgcaggatcagaaagacaaaaagatcgtgatgtactgcaccggcgggatccgctgtgaaaaggccagcgcctggatgcgccacaacggctttgaggatgtctatcacattgagggcggtatcatcgagtatgcccgacgcgcccgtgagcagggattaccggtacgctttaaaggcaaaaactttgtttttgatgagcggatgggtgagcggatctctgacgatgtgttgtcgaactgtcatcagtgcggcgaaccctgtgatacccacgttaattgtgtcaatgacggttgtcatctgctgtttattcagtgcaaaagctgcgcggagaagtttgagaactgctgtagcccgatctgccaggaagaggcgaagctctcaccggaagagcagcgcgcgcgtcgggcaggacgtgaaaatggcaacaagatctttaacaagtcgcgtggcctgttaaacatgaccattccctcgccgctgaagaaataagcgtggccgcctgaagtcagcttcaggcggcttgctgttttactggcgtacaccctcaaccgagatcatcagctgaaccttctgcgaagctggccccagatctttagtgatgttgaaatctttcagtgcaatttccccttcagcctcaaagccagcgcggtagccgccccaaggatctttaccttcacccagcattttcgcctcgagcgttaccggtttggtcacgccattcagcgtaagatcgccagtaatcttcagctcatcaccctcttttttcaccgctgtggatttgaacgtggcctgcgggtttttgctggtgttcaggaagtccgcactgcgcaggtgcttgtcacgttcagcatggttagtatcgatgctgctggtgttaatggtgacgtcgactttatctgcggcaggattcttctcatcaaaggtgaagcggccatcaaaatccttaaaggtgccgtagagccagctgtaacccagatgctggatacggaactgaataaaggcgtgctggccctctttatcgattttgtagtcagcggcagaggcggtgagtgagccgagtagcagactggcaccggtcatcgccagcagggtctttttaaacatattatttatccttttcagagggagaggtgaaacgcaaacccgacatccgttttaaagtgatatcgcgatcgataaagtgatgttttaccgcagccagcccatgcagcagtgacaggaccacaaccgtccaggccagccagaggtgaatgtcgcctgcaagatcagcctgtttcgccagcaccgttgaacagcgcgggcagggtaaaccagctgaatactgagatgggtttgccatcggcggtggagatcagatagccgctgatcagaatcgccagcagcagggtatacagtaacaggtgggccaccaccgaactgatgcgtaccagcggggaataactgctaagcggttttggcggcggtgaaataatgcgccacagcaggcgaacgatcagcgttagcaacaggatcacgccgatgcttttatggatctcaggcgcgtcgtgataccagctgtcgtaatagccgaggccgaccatccataatcccagcgcaaacatggcgtaaatcgccagcgccatcgaccagtgcagcagcacggcaaccaggccaaactgatgagatgaattacgtaataacataatggggttttcatgaagtaataatctgaaataagcatccacattatgaaatataaaagcaatcatccttacgcttctataactttaattttatattgtgaaaaggttgaataaatcaggtgcgaaatgcgcaatattactgaatgagttatttctgaggcgctggtcgtcaactaaaaagagccggaatttaccaaaagggcgaaatatattctgactttatgtcagtaatagtcaattttcgtcaaagtctgtcaatcgggcggcatcaggctgataccaccctttatcagagtcagaaacgtgagaggcggaagggtgtcagatcaaaagagaacggtttttgctgggcaaattctgcagccagttcgcccaatacgctggcgaatttaaacccgtgtccactgagcccggtaattaacaagcggtctggttcacccggcagggtatcaattataaagtcctcatccgggctaaaatcgtagctgcaggcttcgccatgcaggcagacaccgacgccaggtaaaaactgacgcaggaatccaaaagcttcactgccatcggccgccaccgcgccaaaaggtttacgatcctcaggctgctgcatcaactgaccgccatcatgacgacccactttcagggcgtagttatccgccgggaagccataaaactggctgccatcgcccatttccaccgtaaaaccgggaaacttattgttctcactgtagcggccatctgcctgataccaggcaaacaccttgcgggtgggggcgaccggcaggtcaggaactaatttgccaacccaggtgcccgcactgatcaacattttgcggccccgatagacgccatccagggtagtgacctgctgcagatcgccatcgcgacccagctctgaaaccgggcagttaaacagctgcgcgcagcccgcctgctccgccagctggatccagctgcgtaccgcctgttcacatttcagatagccggactgcggctcaaatacgcccagatagccctcaggcacattgatttgtggccagcgcttgcgcacctcatctggctgcatcacctcaatattgagctgccagcgggtcgcgctgtcgatgacgttctgaataaacggcgactgattcggggcgaggttaagtacgccgctgcgatgcatgatgcgctcaccggcacgctgttccagctcatcccacagcgtttgcgcccgcaggaccaggggaacatagcgttcaccttcaccataggcgtgacgaatcagccggctctcgccatgatgtgtgccctgattatggggaggatgggcgctgtcgatcattaacaccgataaacccgcctgggtggcatagtagcctgccgccgcgcccacggaaccgctgccaacgacgataagatcataaatcatggtaactacgctctaagagacagataatcaaaagcataccagaaacagaaacgaaaaaggcacccctgagggcgcctctttgatgcggcagaaattaatgctttttgaggagtcgttctatctgctcggctgattctatcttggcgatgcctgcttcgaggatcgagataaattgccttgccacatccgttgtcagccagtatgtcgggccaacatccgcttcttcttctttttgatcctgcgacgacaacgagtgcaggcggatcatcatggcgtcatagctgtcaacggtactgatatcccagcccaccagtgggtgagtctgtataacatcttttcttctgtccattataacctccttattactcgttaaacgaagtgcatgatgaggttcaatgcggcttttttattccaatagcgaaacaattataacagtaaacgagggtatcactgtttaaaaaatgccgtgagtcagcttctcacagaatatttgcgtttgaaaggcgggcgtaaaaaaataaaatgcctgacgggcaggcatttttatcagcagtcaaaagacaggcaaaaagcgggcttagccgcgtgagcggactcagagagccggcgtttctggcactacgccgccgccgcgtttttgcagtgtttctgccagacgggcaaagtgctgctgaagctgctcatcatggttttgattttgggcttccagcgacagattgtgtaccagtagctgactggcacgatcgtcaagacagaaaatcagactggaaaaggcattttccagcaccgttaaacgacgcttctgatcaccaatcagtgctaacaactcaccaaaggtcatcgcctcttccggtttatcagtagtcatggtgtcgcacctcctgttatgcgtgacgagcgcaaggatagggcattgatcattaagagtctagatgcaggacggggtaagtgcgagaggggagaaaagataaaaaaaccgggtggcgacacccggaaaaaaagcacagtggcggttaatcagtattgaaccagtcgtcagcgctttcccacgtctgctgcaggatctcgctgatctggtcgcgcgtctcttttccaccgcccagcacgctgagattattggcactggcataacgtaccttgacgtgattggtcgagtcagggaaactgttcatcaatgcggcgcgataattcatcgctcaacgcttctatcgcgccagcaggaagaggtcgggtatttgatacggtaatttcaacgcgcataacagcctccgtttaagatactgtatatatttacagtatcggcaggccggaggcaagtaaaattatgcgatgcgccagttcagtgtttcacccgccaggaacggcaccagtgaatggctgccgagcgcgatggactctggcacctgccaggactcacgcaccaaagtaatcgtcccttcattcagcggcaggccgtaaaaacgcgggccattctccgaacagaacgcttcaaaatgttccagcgcgttcagctcttcaaaaacggtggcgtaagcgggtaacgacactggcgcattaaatacccccgcgcagccgcaactggcctctttgagatgacgcagatgcggtgctgtgtcggtgccgaggaagacgcgcggatgaccactcgcaactaatttgcgcaatgcttcctgatgcacgttgcgtttaagaatcggcaggcaatagaggtgcggacgaataccgcccaccagcatgtgattgcggttaaacatcaaatgctgcggggtaatggtcgcgcccagcgtctcatcggcggcggcaacatattctgcggcgtcctgagtggtaatgtgctccatcactactttcagtgccggaaactggctgcgcagcggcaccataaccgtttcgataaaccgggcttcgcggtcaaaaatgtcgacatgcgcatcggtgacttcgccgtggatcagcagtggcataccgagcttctgcatccgctccagcacgcgggcaatggaggcgatatcggtaacgccatggctggagtttcgtcgtagcgtgcgccggatagagcttagccgcggtaaacagaccggaggtgaaaccgcgctcaagctcatcaggatcaagcgagtcggtcagatagcaggtcatcagcggcgtaaaggcgtgatcggcgggcagcgccgccaggatgcgatcgcggtacgcttcacctgctgccacgctggtcaccggtggcaccaggttaggcatcacaatggcacgaccattcaccgcgctggtatagggcaggaccgtgttgagcatctcatcgtcgcgcagatgaatatgccagtcgtcagggcgacgcagggtaagttgctgaggttgtgctgtcatcagtgaagctccggcagaagggaaacaaaaggcgtgttttggccggggtctaagcataaggattcaggcaaccgtttgcacctgctttttatgctgataaagaaaatccgctgcccaacagggtaatgctggtcagttaagattagatttgtaaaggctgtcacggtcaaacgtggcagcttttttccgggcgagcgagccgcagtgcgggccagagcacctctgctgctgccgggccgtcctcgcgccgctcacgcggtaccttcggctttgacgtcgtgccgacgaaccgttcggggatgggccctccctggccggccccgaactgtccacgcttcccggcgtggacttctggcccaccgtcacgcctcagcgctgcggatagccctttcagcagcagaggcgcgaggaccgccagcccctgagcggcaccagactgcgttgtcacctgtcgcttaactgactggcattactgcgtaaagggaataaccagttcgccaggtttcacttctagtcctttggcaaatttcttcgccagcgactcgcctttgctgcggtcggcgctgagcacgtaagccggcttttgatcaaagtagtttttcagcgactgattcagataaggcgtcagcgttttcataatggaggccattttttccggagcaacctgcgcatcaacaatttccagatcgcgcagatagattgcaccctgctgctggtcatagaccggctgagcacgcatcttcagttgcatatcggcctgctgcggaccaaacagtgacgtcacattgattttagcattgccagagagcgtcactttacctggctcttcacggccaatctgactggtcaggttgttcaggacgatgtgcgcattaaccagccccgaaacgccaatatctttctcatagttgttgtgcttctgcagcgcctggtttacttcctgttcgctgatggtgtattgcgtcagttgattacagccgctcaccagcagcgcgatcaacagggcagtcagcccgaaaaaagcctttttcatcgatctttatcctgaatatcagagccaataaacaggccatagcctgcctgaatgcgtagcgggtgtcatcaggaaagagatgagaaacgccgcagcgtctctcatcgggaggggttagtgagctatcgaggagagcagattcacctgggtctgtttagcaatgttatcgcggtagtcagcgacccggctcggccagtcgattcctgccaccagcgtcagagagcgcagcagcgggaagagattaaaatcatcttcggacagctcgccattcaccgcattgggctggacgattaatttgtccagcttgcgcagatcgtcgctgacgtttttaatcaggccggcagaatgacttttcagcgtgtcgaaatcaccgatgctcgcctgctttttgttgcggaaatagtcacgcgcctcaggcgtcgcgaattcggcaaacgccgcctctgcaatgcgcggcagcagcagtttattgacatagctgttcatgtgacgcagccagtcgccgatcgccggatttagcgcgccgatgatcagcggttcgccatcctgctgatcgacatagtgtacgatctccatactttcaggcatcgcgctgccatcctgcttctgcagaatgggcgccattttctgtccgatcagtcgtttcggcgtctcttcatcgtcgttgagcattaccaccagctcaaccggtttgtttttcaggccaaaaatcattcgcgctttaacgcagaaagggcagtggtcgtagatatagagcttcatcctgatctcccggattttacaggtttagtgtttaacagagtgaatcaattcatcctgctttcgggctcgtaaaaagtatggaagagattaccccacagggcaaacctgcctgtcaggcgcgctgcaggatccgctggtgatgccgcctgcagcaggggttatccgcggtgcgacccgagcaaaatcatcctctttatcgctaaaccgctgtaacgttttaccgcagcccaggcggcggttatagtgaaagccgggtaatgacggctcatctctatcagccattgatttcaggagtcaggatgtttggctatcgtttctgccgcgcccagggtgcgattaaccaccgatcggctggtggtccgtctggttcacgagcgtgatgcctggcgaatggcagattactacgcggaaaaccgcctgtttttaaaaccgtgggagccggtgcgtgatgacagccactgctacccttcgggctggcaggcgcggcttgggctgatttccgacatgcataagcagggttcggccttctatttcattttaatggacagcgatgaaaccgaagtgaggggagtggcgaacttcagcaacgtgttacgcggatcctttcatgcctgttatctcggctattcactgggtgaaaagtggcaggggcaggggttcatgttcgaagcgttgcaggtggcaatccgctatatgcagcgccagcagcatattcaccgcatcatggctaactacatgccgcacaaccagcgcagcggcgatctgctggcgcgactcggttttgagaaagagggttacgcgaaagattatctcctgatcgacggacgctggcaggatcacgtgctgacagccttaaccctgcgggaatggacgcctgaccggcgtggataataatgaggatgcgagcatgaagatgactttatcggcgcaggcgatgcgcgtgctgggctgcctgctggagaagcaggtcaccacgccggaacagtatccgctgtcactgaatggcgtggtggtggcctgtaaccagaaatcgaaccgcgagccggtgatggagctgagcgaaagtgaggtgcaggatcagctcgatcagctggaaaaacggcatctgatcaccgccagcagcgcagccgggcagcgggtcgtgaaatatgagcagcgtttctgcaactccgcgtttggcacgctaaagcttaacagcgcagaagtcgctctgttgacgctgctgttactgcgcgggccccagacgccaggcgaactgcgtacccgcagcggccgtctgcacgagttcagtgatgtcagcgaagttgagcaaacgctggaaggattgatgcagcgcgacgacagtgctcaggtgatccgtctgtcgcgtgaacctggcaagcgcgaaagccgctttatgcatctgctgggcgatgagcctgaccagccgcaggccgcagacgcgtcggaagagcagggcgaactggcggcgcgcgtcgcaacgctggaacagcaggttgcagcgcttcaggcacaactcacccaactgctgcaaccggagagctgagatgaccttacgtattggcatggtgggattaggcggtatcgcgcagaaagcctggctgccggtgctgtcggcggcgacggactggaccctggcaggggcgttttccccgaaccaggccaaagcccggccggtctgtgacagctatcgcatgccatattttggttcgctgaatgaattagccgctgcctgcgacgcggtctttgtccacagcagcaccgccacgcactatgaagtggtcagggcgctgctgctggcaggaaaggatgtctgcgtcgataagccgctggctgaaaccctggaacaggctgaggcgctggtggcgctggcggaaaaacggcagcgtaaactgatggtggcgtttaaccggcggtttgccccgcgctatcagcagctgcgggcggagatggcggacgccgcttctctgcggattgaaaagcaccgtagcgacagcgtcgggccacaggatctccgctttaccctgctcgatgactatctgcatgtggtggataccgccctctggctgggcgggaaaccctttcgccaggtttcagggacgcatcgacaccaacgaacaggggcagatgctctatgccgagcaccatttcgctgttgagggattgtcgattaccaccagcatgcaccggcgcgcaggcagtcagcgcgagcgggtcagcgcagtgtgtgacggtaaatgcatcgacattagtgagatgcgcgactggcaggaagaacggcgtgacgggctgctgattacgccaccgcccgcctggcagagtcatctgacccagcgcggcttcagcggtgcggctcgccatttcatcgactgcgtacaaaatcagacgaagcctgaaaccagcggtgagcaggcgctgatggcgcagcgtgtggtggaaaaattgtggcgtgaggcgacgcaggaataacgccttgtaacactccgtgctggtcatttccctccgtggcagtagactgtcgccgggcatcttctgggtgcccgcgctaattctccttttttgccgattcttttcaggatgcgccgtcaattatgaatttgttgaaatcgctggcagcggtcagttctatgaccctgttttcccgcgtactgggctttgcccgtgatgccatcgtggcgcgggtgtttggcgccggaatggcgaccgatgcgttctttgttgcgtttaaacttcccaatctgctgcggcgtatttttgctgaaggcgccttttctcaggccttcgtgcccattctggctgaatataaaagcaagcagggcgaagaggcaacgaaactgttcctggcttacgtctcgggcctgctgacgctggcgctggcgctggtcacggtggcgggcatgattgctgcgccctgggtcatcatggtgacggcacccggctttgccgacagtcccgataagtttgcgctcaccagctcgctgctgcgggtgacctttccctacattatgctgatttcgctggcgtcactggcgggtgcggtgctgaacacctggaaccgcttctcggtaccggcctttgcaccgaccctgctgaacgtcagcatgattggctttgcgctgtttgccgcgccgcacttccacccaccggtaatggcgctggcctgggccgtcgtggctggcggcgtgctgcaactcggctatcagctgccacacctgaagaaactcgggatgctggtgctgccacgcctgaatctgcgtgatgcgggcgtctggcgggtcatgcgtcagatgggacctgccattctgggcgtttctgtcagtcagatctcgctgatcatcaataccatcttcgcctcgtttctggtctcaggttcggtctcctggatgtactacgcggaccgcctgatggagttcccctcgggtgtgctgggcgtggcgctgggcaccattctgctgccgtcgctggccaaaagttttgccagcggcaaccatgatgaatattcccggctgatggactggggtctgcgcctctgttttctgctggcgcttcccagcgcggtggcgctgggcatgctctccggcccgctgaccgtggcgctgttccagtacggcaaattcactgcctttgatgctctgatgacgcagcgcgccctgatcgcctactccgtcggactgatggggctgatcgtggtcaaggtgctggctccgggcttctattcccgtcaggacatcaaaacgccggttaaaatcgcgattatcactctgatcatgacgcaggtaatgaacctggcgtttattggtccgctgaaacacgccggtctgtcactgtcgattgggctggcagcctgtctgaatgcgtctttgctctactggcagctgcgtaagaagaatatctttatgccgcagccaggctggagcagcttcctgatccgcctgctgatagccgtagtggtgatggcaggcgcgctgtttgccatgctgcagtggatgccagcctgggagcagggatcgatgctgtggcggctgctgcgtctggccgcagtctgtggtgtgggcggcggggcttacttcctggcgctgggaatgctgggcttccggctgcgcgactatgcgcgtcgcaccgctgtgtaaagcttgccgcaataaataaattcaacgcgcagggaacaggggcagaggaggaaagcgtcccgcgccatggacaaaaacgccgggagcgtttttgaacaacgcaacgcgttggcccggcaacgggcgcacctcagggatgaggtgcgtaatcgcgcgggccgagcggccagggattggctttagcgtctttccgatctgcccctgttccctgtgcaggctcaattttaaagctcatcatggtgaaggaaaaaacgcaccaataaaaaatcccgcaccaggcgggattttttttcgctaatttccggttcaggctttgcgacttaacgtcgcctggcctttacccatcccatccgggccgtaaaaggcctgggtctgatgcggcttcagcacgtcaagcgcatcctgggtgtagcggatctggtgttgcagcagcaggccgttatgaacattggcatcctgcagacgacggctatgctgctggatagtgtcccagcggcgcgccatgtcgttctgaccacgataaggtgccgatgtcgcctgactctgctcagcggtgcggcgcatctcatccagatagttcagcgtactgagcagcgcgcttttatcttcggtaatacgctgcaacagattactgttaatgtttccggctgccagttgctgctgctcttcttccagcacggctgagagcgacgccagcacgtcctgcatcttatctaaggtggtctgcaaattactcatgggaactaattaccctctaaatacgccttggtgtcggcaatcagcgcatcggcgattttgccggtatccatcttcagttcgccattacgaatggcggttttcagttgttcaacgcgctcgacgttaatatctttgctgctcggctgcatcagctgcgactgcgcgctgctcaggctgacctgggctgctgcaggggtcgtggctgctgccaccgggctggcgctctggcgcactttgctgctgccggactcactgctatcgcggctctgtacggtgctggcgggtttcagaggttgcgttctgtcaatgctcatgttcgggctcctgtacggtcaggggaagtctgccacctgaatcagaatagcgttatcgcttcgttgattcttctatcggcagcactactggcttctttaacactttacagcgttataagaatattcccatcctcgcgtaccttaccgctgacaatctggccatttcccatcctgacccggaccgactgcgatcgggcggcgttattcagcgccttgccctcaccgctggcgtcaaagccgtcaccgctggcaatcaccatcacattctgacccgccttcacacgccacggctgacgcagcgtggagggattaatcggctgtcctggctggatatcgcgcagcaccacggcgtctgcgaccgagtccgcattcagcagggcgcgggcaggcagagtatcaaggcggccggtctgcagagtgaaatcactctcgctcacgctactgccctggctcagcagccggttcgccaccagataggaaccggtgacctgcacctgtacctgaatataacggcggttctcaccacagtttgccgccacgctcatattgccccacaaccggctgttgccgggcagggtgaactgtggtgcctcacaggctggccactgttcctgcggtgtgcgtaccaccacgaccatgccatcagcatgctgggcgtcacgcgctttaaaaaattgattcagttgtgcattgagatccccggcggaaaccggcagggcgatcgcgaccagcaggctggtcagcagggtcagatatcgacgcattgtgcatttcctcactgatgatggcgacgagtgtaccccttaagaaaaatccttaattgtcaaaatagcggtcatttgaggccttattcagacgatgaccccttgcattttcaaattaagctgcgagctcgaaattctcatacgcggaggaaacatgctcgacaaactggatgcggcgctgaaatttggtacggaggccctcaacctgcgtgctcaacgtcaggagatcctggcgtcaaatattgccaacgccgatacccctggttatcaggcccgggatatcgactttgccagcgagctgagtcgggtgatgtccaatggtcgtgcggaaggcagcagcatggcgttaaaagtcacgtcagctcgccacattgaagcacagacaaacggcgtgccatcgatggatatgctttatcgcattcctgaccagccttctgccgacggcaacaccgtagatatggaccgtgagcgtacgcagttcgcggataacagcctgaaatatcaaaccgacctcaccctcatcagtagccagatcaaaggcatgatgagcgtgttacaaggacaataattatggccttgctgaatatttttgacattgccggttcagcgatgaccgcgcaatcacagcgattaaacgtcagtgccagtaacctggcgaaacgccgacagcgtcaccggccccgatggcaagccttacgtggcaaagcaggtggttttccagaccgatgcggcgccaggctcagccaccggcggcgtgaaagtggcaagagtcgtggatgaccctacacctgccaagctggtctatgacccgggcaatccgatggcagatgccaaaggctacgtgaagatgccgaacgtggatgtggtctctgaaagcgtcaacaccatgtcggcgtcacgcagttaccaggccaacgtcgaagtgctcaacaccgtgaagtcgatgatgatgaaaaccctgacgatcgggcaataacggagaaaaattatggctatcgcggtaggcgttaacgaaagactggaccccacggtccttagctcctctaacaccagtggcaccggcaacaatgcgcaggatctgcagaatcagttcctgaccatgctggtgacgcagttaaagaaccaggatcccaccaatccaatggataacagccagctcaccacgcagctggcacagatcaataccctgagcggcattgaaaaactgaataccacgctgggatcgatctccggccagatcagcaccagccagtcgctgcagagctccacgctgattgggcatggcgtgatggtcaatggcggacaggttctggtaggcaacggcaccacaacgccatttggcgttgagctggcctccgcctcaaccggcacatcggccaccattaaagatgccagtggcacggtgatcgacaccgtcgatctgggcgcgctgagcgctggcgtgcacaccttctcgtgggacggcaagctgacagatggctctgtcgctccggatggtaaatacagcgttgcgattgccgcaagcaatggcaacacacaactggtggcacaaccgcttaactacgcctacgtcaatggggtgagtactgcgaacaacaccacaaaactggatctcggcaccatgggctccgccacccttgacgacgtacgtcagattctctgattaacctgtagacaggaaacaaacacatgtcattttcccaagcggtcagcggccttggtgctgcttcaagtaaccttgatgtcatcggtaacaacattgccaactccgccactgcgggctttaaatcgagcaccatcgcgtttgccgatatgtttgccggttctaacgtcggcctcggtaccaaagttgctgcggtaatccagaactttaacgacggcgccaccaccacgaccagccgtggcctggacgttgcgctgagcggtaacggtttcttccgtatgaccgacagcagcggcggcgtcttctattcacgcaatggtcagttaacgctggatgccaaccgtaacctggtcaacacccagggtctgaacgtgaccggctatccggccagcggttcaccggccactatccaggcaggtgctaacccggtggcgctgcgtattcctaccgagcagatgtcagcccgtgcgaccactaccgccggtctggttgccaacctgaactcaacggacaaaacgccatctgtggccaccttctcgacggcgaaacgcagacagctacaacaagaaaaccacggcaaccgtgttcgactcgcagggtaatgaccacgcgctcgacatgtatttcgtgaaagacaccaccagcaacagctggaccgtgcgtaccattgatggcaacaccggcagttcagcgggtgacttcagaatggcgtttgacaccagcggtaagctgaccagcgtctctaagctggatgccaccggcgctgtcgtcagcacgacgaccgatggcaccgtcggcctgacgctgaacgtgggcggagcgaatggcgcagtcgccaatcagccaatcaacctgagcatgctgggcagcctgcagcagaacaccggcagcaccacctttggcagcccgacccaggatggttatgcacctggcgatctgaccagctacgcgatcaatgatgacggcaccatcaccggcagctattcaaaccagaaaacccagctgctgggtcagattgtcctggcgagcttctctaacccggaaggtctgcagtctcagggcgacaacgtctggtctgcgtcaagtgcatccggtcaggcagcaatcggtctggcgaataccggcacctttggttcactgacggctggcgcactggaatcttccaacgtcgacatgagtaaagagctggtgaacatgatcgtcgcgcaacgtaactatcaggcgaatgcgcagaccatcaaaactcaggaccagattctcaacacgctggttaacttacgttaattcgctaacaggattgccatatggatcacgcgatatataccgcgatgggcgcggccagccagacgctggatcagcaggcggttaccgccagcaacctcgccaacgcctctacaccgggttttcgtgcgcagctgaatgcgctgcgcgccgtgccggtgagtggctggtcgctgccaacccgtacgctggtcgccgcctcgacaccgggcgccgacatgagtcagggcgcgatggattacaccgagcgtccgctcgatgtggcggtgcagcaggatggctggctggcggtgcgtaccgctgacggcagcgaagcctatacccgcaacggcaatatgcaaatcagtccgaccggtacgctgacggttcagggcaatcctgtgatgggcgatggcggtccgattgtgatcccgcagggcactgaaatcaccattgcagccgacggctcgatcaccgggctgaatgccggtgattcaccgaacgccacggttcagctgggcaagctgaagctggtcagggcaaccgggcaggagctgcagcgcagtgatgacggcatgttccggcctactgcgtcggcgcaggcgacccgcggtgccgcgctgcaggctgatgccaccatgcaggtgatgcctggcgtgctggaaggcagcaacgtcaaaccggtagaaaccatggttgatatgatcgccaacgcccgacgttttgagatgcagatgaaagtcatcaccaacgtcgacgaaaatgaacaaaaagccaaccagctcctgagcatgggttaaggcacgaggataacaacatgattcgttctttatggatcgctaagaccggtcttgatgcgcagcagatgaacatggacgtcattgccaacaacctggcaaacgtcagcaccaacggctttaagcgttcacgtgccgtgttcgaagatctgatgtaccagactatgcgccagccgggcacccagtcatctgaacagacaacgctgccatcgggtttgcagatcggtaccggtgtacgtccggtgaccactgaacgtctgcatacgcagggcaacctgtcgcagaccagcaactcaaaagatatcgccattaacggccagggttattttcagattcagatgccggatggcacctctgcttatacccgtgacggcgcgttccaggttgatcagaacggccagctggtgaccaactccggtttcccggtacagccaggcattaccattccggctaacgccaccagcattacggtgtcgcgtgacggtgtggtcagcgtaacgcagcagggacaggcccaggccgcgcaggtcggtcagttaaccctgagcacctttatgaatgacgccggtctcgatagcgtgggtgaaaacctctacaaggaaacgcaggcatcgggcgctccgacagacagcacgccaggccagaaacggcgcgggcctgctctatcagggctataccgaaacctcgaacgttaacgtggcggaagagctggtcaccatgatccagacgcagcgcgcttacgaaatcaacagcaaggcgatcagtacctctgatcagatgctggcgaaattaactcagctttaatcccgaacagggccagcccgtgctggcctgaatgacagacattaataaggtcgtgacgccgtggcgaagcaacagattctcaagcctggacattggttagtcgcctcgttgctgctaactctcaacggatgtgccctggtcccgcgtaccccgctggtcgaaggtgcaactacagcgcaaccaatgccgtccgcgccaccggtggtcaacggctctatattccagggcgtcgcgccgcttaactacggctatcagccgctgtttgaggatcgccgtccacgcaacattggcgataccctgaccattacgctgcaggaaaacgtcagcgccagcaagagctcctcagccaatgccagccgcgatggcagcaacagctttggtgtgagcgctgtgccgaccggtctggcaggcctggtgggtgcaggtggtgaaaaagccaacctcagcgccgaaggcaaaaacgatttcgcaggtaaaggcggcgcatccgccaataacacctttaccggcaccattaccgtcaccgtggatcaggtgttgtcaaacggcaacctgcacgtggtcggtgaaaaacagatcgccattaatcagggcacggagttcattcgcttctcgggcgtggtcaacccacgcaccatcagcgccagtaacgccgtgttatctaccgctgtcgccgatgcacgtattgagtacgtcggaaatggttacatcaatgaggcgcagaccatgggttggttccagcgtttcttcctgaacatctcgccgatgtaagaggtttcaatgaaaaagttaacgctgttacgcgccgggctggcgctgctgctgggcgtcagcctgctggcaaaagccgatttgattcgtgatttaaccacggtacagggcgttcgtgataaccagctgctgggctacggcctggtcgtgggcctggatggcaccggtgaccagaccacccagacgccatttactacccagacagtgagcaacatgctgtcgcagcttggtattaccgttcccaccggaaccaacatgcagctgaagaacgtggcggccgtgatggtcaccgctaaactgccctcgtttgcccgtcagggacagaacctggatgtggtggtctcgtcgctgggtaacgccaaaagcctgcgcggcggcacgctgttaatgacgccgatgaaaggggtcgataaccaggtttatgcgctggcgcagggtaatatcctggtcggtggcgcgggtgcgtcagcgggcggcagcagtgttcaggttaaccagctgaacggaggccgtattaccggcggtgcaaccgttgagcgtgaactgcagagcaactttggtacgcagaacaccattaacctgcagcttaacagcgaagatttctcaatggcgcagcggattgctgatgccattaacgcccgtggcggttacggcgcagcgcagccgctggatgcccgtaccgtgcagatccgcgtatcgcctaataatggtgcgcaggtgcgtctgctggctgagatccagaacattaatgtgtctatcccggttgaagatgccaaagtcatcatcaactcccgtaccggttcggtggtaatgaaccgtgaagtgacgctgaatcagtgtgcggtcgcgcagggcaatctgtcggtgacggttaaccagcagcagaaacgtcagtcagcctgatactccacttgccggtggtcagacggtggcgactacgcagactcagatcgatctgcgccagaccggcggtgcgctgcaacgcgtcaacgccagcgccaacctgaacaacgtggtgcgtgcgctgaatgcgctgggtgcgtcacctatcgaactgatgtcgattctgcagtcgatgcagagtgccggctgtctgcgtgccaaactggaaattatctgatggctgatatgcaatctctgacgagttcggctttcgacagccgttccctgaatgaactgaaacgccaggccagcaacgatccgaaaggacaagcgttgcaggtggcgcgtcaggtcgaagggatgtttgtacagatgatgctgaagagtatgcgcgaggcgttgccgcaggacggcattatgggcaacgagcagaccaaactctttacctctatgtatgatcagcagattgcacaggagatggggaagcgcggcctgggcctggcggaaaccatcgtcaaacagatgcagcccgccaccgcgccggatgaaaaagccggtacggtgccgatgaagctggataacagctttattctcagcaccagcggggcaacaccactgccggcgcagcagctggagcagattgtgcgtaaggcaatgccgcgtctgccgccggtcgcttcaccgacgggtctgcccagtgacagccgcgagtttatcgcccagctgacgcaaccggcgcaggctgccagccagcagagtggcattcctcatcacctgattctggcgcaggctgcgctggagtcgggctggggccagcgtcagatcctgacccgcgacggcaaaccgagctacaacgtgttcgggattaaagccagcggcgactggaaaggtgacaccaccgatatcatgaccaccgaatatgagcagggcgaagcgaagaaagtgcgtgccagcttccgcgtctataactcctatttcgaggcgctgaccgactacgtcaaactcctgaccaaaaacccacgctatgcggcggtgacgaacgcctcaagcgcagagcagggtgcgcaggccttacaggcggccggttatgccaccgatccaaaatatgcgcaaaagctggtgggaatgattcagcaattcaaaagtatgggcgacaaagtcgtcaaagcttacagtcaggatatgggcgacctgttctgatcattgcgcctcaagtttcactttagcaagccgataacatccctatagccagaagcgttttcgcctgctggcgcccactttgatgtctgccagcccggttgacggggaacgtaaggaaccgagatgtccagcataattaactccgcgatgagcggattgagtgccgcgcaggccgctctgagcaccacgagtaacaacatttccaattacaccgtggcgggctattcacgtcagaccacggtactggcgcaggcgaacagtaccctgcagggcaatagctattatggtaacggcgtgaatatcaccggtgtacaacgtgaatatgatgcgtttattgctacgcagctgcgcggttccagcgcgaaactacagcgcggtaagcacccagcatagccagatttctaacattgacgatctgctgtcgacttcgactaccagcctgtcgacctcgctgcagggcttctttactaacctgcagaacgtggtcagcaacgccaacgatccgtcggcgcgtcagtcgatgctcagcaatgcgcaggggctggtcagccagttccagacatcagcgcaatacctgaacaatatgcagaacagcgtcaatgccgatgtcgattccagcatcaagcaggtcaataccctcaccagccagattgccgatctgaacaaacagattggcaaactgagcacggcaaacggtgccgcaccaaacgatctgctcgataagcgcgatcagctggtgaataccctgaataacgtggttggtgtgacggtatcgcagcaggatggcggctatacggttgcgatggccaatggcctgacgctggtgaacggcgacaaatctcacgatctggtggcgatgccttccagcagcgatccgacacgcaccaccatcggctatgtcgataaacaggcgggcaacgtcgagatcccggaaaagctgatcaccaccggttcgctgggcggtctgctggcgttccgtactcaggatctggatctggcacagaaccagctgggtcagttagcggcggcgtttaccaccagcttcaacgatgtccacaagcagggatttgatagcaaaggcaatcagggcgtcgatttctttaatatcggcagcccgatcgtggtgggcaacagtaaaaacagcaccgccgcgtccgtcaccgctgagtggaccgataccagtgcactgaaagcatccaattacaccgtgagttatgacggcaataactggaccgcaacccgagcctcagacagtgcggctgttaccatcacgccaggtaccgatgccagtggcaacaccacgctgagctttgacggtctgaaactgaccgtcgccggcacgcctgcacctgctgccaaagacagtttcctggtgaagccggtccagaaacgccatcaacgatatgtcagtcgcgatcaccagtgaatcgcaggtggccgccgcgggtgccgtaggcggggagagtgataaccgtaatgcgcaaaaactgctgaatctgcaggatgtgaaactggtcggcggcaacgccacgctgtctcaggcctacgccaccatcgtcagtagtgtgggtaacaaaaccagttcactggaaaccaccagcaccactcagaaaagcgtggtcagtcagctgacccagcgccagcaatcggtctctggggtaaacctcgatgaggagtacgccaacctgaccaaatatcagcaatattacatggccaatgcgcaggtgctgcagactgccagcaccgtgtttaatgcattgatcaatattcgctaagggcaggagataacatgcgaatcagtacaaatatgatttttgagcagcaggtgcgcggcatcactgactcacaggcctcctggctgaaatcaggccaggagctttccagcggccgccgtgtgaataatccttcggacgatccgattgccgcgtctcgtgctgtcgtgttgtcacaaacccagcagcagggcaagcagtatgcgctggcgcgtacctttgccgagcagggtctctcactggaagagaatacgctgaaaggcgtcaccgatgggatcattgctgcccaagggctgatcgtcaacggttcaaccggtacgctgagcgacgatgaccgtggttcgattgctacccagctggagggtatccgcgcccagttgctgaaccaggcaaacagccaggatgccaatggccgctatatttttgccggttataaaactgacagtgcgccatttgtggatgcggcaggcaccggcgtcggctacgcaggcggcaccgaggcaatcactcagaaggtcgataccagccgtaccatgactgtgggccataccggtgacaatatctttatggcgatctccggcaatgccaccaaagagccggatggcagcgccagtgaaacgaatgtgtttaagatgctggatagcgccattgctgcgctgaaagtgccgcaggatgatgctgacgccgcaaccaaacagaccttccaggcggcgatggataaaaccaaccgtggcctgggtaactcgctgaataatgtcttaaccgtgcgttctgagattggtacccagcttggtgagatcgatacgctgaatgcccagggcgatgaccgtagtgtgatttacagctcgcagatgagtgacctggttaacgtggatttaaccgaagcggcttcaaactacaccatgcagcagacggcattacaggcgtcctataagacctttaccgacatgtctaagatgtcgctgttccagatgaactcgtagtcttacctgaaattttgagcgtactttaaccggatgcgcttacttttcccaccctcccgctaaaggagggtgggatttttttgcctgcgattcagccggtggcgggaaccatagaaattaaaccgggttgatttacagcgacagtcagctcgcatgtcagtcttgctttcacgctttcacgcacacacgcacacacgcacacacgcacacacgcacacacgcactttcctgattcctgataaacgaggaggggaggttaattatcctctgtccgctggcgggcagaatcgcaggcataaaaaaaccccggcttgcaggccggggtttagttcacaacagcttatgcgttacggcttggtcgccggggcagtggcatgatgtgtggcgctatgaccacccgcagaaccgcgaccgtcgaactcataaggtgcacgcacccagtcactgtgcggtgccggttctgactgccagactggcgcaggtgctttagtcatcggcgcagaggcaaaatgcttccagcgcgtaccgtcattcggcactgatgccgttgcaggctcggatgccgttgcaggcactgatgcaacaggttcggccgtagtgacctgtgctgcaggggcgacatcgcgtgcggccaccggagcatgaggttcacgaactggcgctgtttcagcttcagcagcgaccggcgcattcagaacttcctcaacttctgctgcgatcgcttcgctgacgtcggtagccgattgctcagcaacctctgaaggctgtgcttcttctgcaactgctgcaggctgtgcagtctcaaccgcaggtgtcacaaccggcgcttcggtgacaggctcagcaggcacggcttcggctgctaccgcttccgcttttgcttcatctgccgccggaacaacggaaggctgctcgtcaaccggcgcgtcgatagcacgggtatcgtcagtgttcacgaccggcactggcgtttctgcctgcggctcggcctgttgcacaggcgcttcctgagcaacagattcaacagcggcagcaacgggctgcgcactggcggcgtctgctgtctcttcgcggttgtacgctggcgtctcgtgagtcacattctgaacctgctcttcgctggcctggctcaccgggtaacggatccagactttaccggatgccatctctggtgatgcagctgcagcggccagcggcattgctgactgagtcggataacgctcatcacggtaacgacgacgacgctgtccgctgacgcgaagatgacgaggcgaacgacgtgaacgacgcggcatattggcgttatcacggttgtcgttgtcatcctgctcttcaccctgcggtgcctggaactcaggctgcggctgagccacgtctgtctgctgaggctgacgcacttcagccggctgggcaaagtcgctggcttcggctggcataggtggacggttatcatcaacacgcaccttctggttcagctgacgcggcttgcgacgcggcataacctgtacgcgctcatcatcctgcggctcggtcacgtccggaacgtcggctaccactaccggctgctcagccactttggcggcttcttcaccggcacgtttctcttcctgacgacgacgctgacgctcagcacgctgttcacggcgctgttgctgctgctcatcacgctgctggcgcgcttcttcgctcagtgctggacgctcttcacgcacttcaccagcctgggactgacgcttgttacggcgattatcgttaccctcgcgcggctcgcgattttcacgtggctcgcgactttcgcgcggttcacgactttcacgaggttcgcggttttcacgaggctcacggttttcgcgtggttcacggccttcacgcgactgcgcgttatctccgttgcgcggcgtacgctcacgacgattattgttacgacggttgttattgttgttgcggcgctcgccacggccgttgccgttttcctgctcgctttcaggcgctttctgcggctctgcaacctcagtggccacgggggcagcggcaggggtttcttcgcctgcgaacatttttttcaggccaccaagcagacggccaaagaagccggtgctgacggtagcaggcgcagccacagcaggtgctgcttttgcggctggctgggcttcagcgcgctgcgcttctggctcaacttctaccggtgccggaggcgcatcaggcatcacaaacgcggccagagcaggctgctcaggacgacgacgttcagcatgttcctcttccgacggcatcgccatttcggcttcatgcagcttcggcagatgatagctcagggtctgcgtctcttcgcctttgcgcacgcgcagcacggagtagtgtggggtctgcatcttgtcatcaggaacgatgatagcccgcacgccaccctggcgtgtttcaatagcgttaaccgcttcacgtttttcattcagcaggtaagaggccacctgaaccggaacaatggcgtgaacttctttggtgttgtctttcagcgcttcttcttcaatcagacgcaggatcgacagcgccagtgactcgttatcacggatggtgccggtgccgctacagcgtgggcagacgtgatggctggattcacctaatgacgggctcagacgctgacgggacatctccagcaggccgaaacgtgaaatgtggctgatctgaatgcgggcgcggtcctgacgaacagcttcacgcagacgattctcaaccgcgcgctgatggcgaaactggcgtcatatcgatgtaatcgataacgatcaggccgcccaggtcacgcagacgcagctgacgagcaatctcatcggccgcttcaaggttggtgttgaacgccgtctcttcgatatcaccgccgcgcgttgcacgtgctgagttgatatcgatagcggtcagcgcttcggtactgtcgattacaatcgagccaccggaaggcaggcggacttcacgctggaaagcggattcgatttgcgattcgatctgatagtggctgaacagcgggatttcaccggtgtagagcttaattttgctgctgaagtccggacggcccagcgcagcgatatgctgacgcgccagttccagtactttcgggttatcgataaggatttcaccgatgtcctgacgcagatagtcgcggaaggcacgcacaatcacgttactttcctgatggatcaggaacggagcagggcggttttcagcggctttcttgatcgcttcccagtgtttaagacggaagcttaaatcccactgcagcgattcggctgatttaccgacgcccgcagtacggacaatcaggcccatgccttccggcagttccagcgccgacagggcttctttcagctcggtacgatcgtcaccttcgatacggcgagagatgccgcctgcacgtgggttgttcggcatcagtaccagatagctgcccgccagagagataaaggtggtcagcgcagcacctttattgccgcgttcttctttatcgatctgaacaatgacttcctgaccttcacgcagcacgtctttaatattcggacgaccatgcgcgttgtagctggaggggaagtattcgcgggagatttcttttaacgggaggaaaccgtgacgctctgcgccgtaatcgacaaacgcagcttcaaggctgggttcaatgcgagtgattttacctttgtaaatgttggcttttttctgctcgtgtccaggactttcaatatccagatcgtacagacgctgaccgtcaaccagggcaacgcgcaactcctcctgctgagttgcgtttattaacattcttttcatcgtgacttactcgttattctttcatgagtgattacagctgcgggcatagttaccctggacgagtatcaaccgatggccccgtgacttagtgcaatgtcgtcaacctcacggctgtcgaccgcgcgaggggcgcaaataacgtcggtggcctgtttttcataagggaaaacagcaccagatagtggaaatgcctgagagaataaagaaaacccgtgcatcccatactgttgtccaggccgcaacccgcagcccgctaagtgcctgatttcgcattacgtcttacgccattgctgcgtgtctgctcaatccggcaaaatgacaatttcgctctttttctgccctgaaatggttcaggtaagaaactcaagcattattccattgctaaccttcatatagcaaggcgactttagccagcttgtgaagtttctttacatttaaatcgctaatgtgtcggacaaaacagcgctttgctgaaaaagccagcagagaggcgacctgccgtcacatcaactccagagttaagcacagaaaaaggggtggcgctatcaggggacactatttagaatcgccgccatgaaaacagagaatcccggcgtacattttgtcgccatcacggctgaaaatgccggacaacgcattgataactttttgcgcacccagctcaagggtgtgcccaaaagcatgatttatcgcatcgttcgcaaaggcgaggtgcgggtgaataaaaagcgcgtcaagccagaatataagctggaggagggcgatgaggtgcgcattccgccggttcgggtagcggaacgcgatgaagatgccgtttcccccaaactggcgaaagtggcgtcactggccgatgccatcctgtttgaggatgagtcgctgctggtgatgaacaagccttccggcacagccgtgcatggcggtagcggactcagcttcggggtaattgaagggttacgtgccctgcgaccggaagcacgctttctggagctgatgcatcgcctggatcgtgacacctccggcattctgctggtcgctaaaaagcgttcggcgctgcgttccctccatgagcaactgcgtgaaaaggggatgcagaaagattatctggccctggtgcgcggcaactggccgtcacacctgaaggtggttcaggcgccgctgctgaaaaacatcctgcagagcggtgagcgcgtggtgcgcgtcagcagcgaaggcaaagcctcggaaacccgctttaaagtagaagagcggttcgaatttgccacgcttgtgaaagcgagcccggtcaccggtcgtacccatcagattcgcgtccatacgctgcatgccgggcatcccattgccttcgacgatcgctacggagaaacgtgagtttgacagtcagctggcggcaaccggtttaaaacgccttttcctgcatgctgcggcgctgacctttacgcatcccggcaccggcgaagtgatgcgggtcgaggcgccactggatgatggcctgaagcaatgcctgcttaagctgcgtcagcggaaagcgtaatctctccggcatcagttcgttaaaggattgatgccggcctgctgcaacatctcattgagcgcgatcaacggcagcccgaccagcgtattaggatcgcgtccctccagccgatcaaacagacaaatccccagaccttcacttttaaaactgcccgcacactgaagcggctgctccttttccacatagccgctgatttcagcgtcagttaacgtgcggaaatgaaccacaaagggctcacagcagtgcagcagcgtgccactgaccggatgaaatagcgccagaccggtataaaaggtaatggcttttccgctggcggcacgcagttgcgcccgcgcattctcagccgtgtgaggcttaccggcgatagcgccatccagcacgcaaacctggtcggagccgattatccagtgtctgggatacgtttttgccagtgcctgcgctttagctacggcaagacgggttaccagcgcttcagcggtttcatccggctggggggactcatcaacctcaggcgcggcggtaataaaaggcaggcccagtttatgcagtaatgcctgccgaaagggcgaggttgaagctaaaagaatcgatggcgtcattttttttcaatagtgatagcgaattggtgacagtcattttaaactgtgcgccgcactggatgcgaatagtggttgaaagatgctgtttaacggcctttttctttgactctatgacattacaaagttaatatgcgcgccctatgcaaaaggtaaaattacccctaacgctggaccctgtccgcactgctcagaagcgccttgattatcagggtgtctacacatctgtacaggtggagcgtgtggccgagtcggtcgttagtgtggacagtgatgtggattgtgccatgtcgtttgcggttgataaccaacgtctggcagtactgacgggtactgctgaagtacaagtgacgttgcgttgccagcgctgcaaccagacctttcctcatcacgtaaaagtgagttactgcttcagccctgtctcttctgaagagcaggccgaggcattgccggaagcgtacgagccggtcgatgtcaacgagtttggtgagatcgatctgctggcggttgtcgaggatgaaattattctcgcgctgccggtcgtttccggtgcacgattctgaacactgtgaagtgtccgaggcggacatggtctttggtaaactgcctgcagaggtggagaaaccaaatccatttgccgtattagccagtttaaagcgtaagtaataggagtaaggtccatggccgtacaacagaataaacccacccgttctaagcgtggtatgcgtcgttcgcacgatgcgctgaccactgctgctctgtcagtagataaagtttctggcgaaactcatctgcgtcaccacatcactgcggacggttactaccgcggtcgcaaggttatcgttaagtaagtttcttgcttagcaaggcgataccttgacacgtttgaccctggcgattgatgccatgggcggggacttcggtccctgcgtgacagtgcctgcagcattgcaggcactggcctctcattcggaactattccttcttctggtcggacatcccgacaccctcatgccattgcttgccaaagcggattcctccctgatggggcgtttgcaggtcatccctgccgaatcggttattgcaagtgatgcgcggcccgctcaggccatccgcaacagtcgcggcagctcaatgcgtgtggcactggagatggttaaagagggacgtgcgcaggcctgcatcagcgccgggaataccggtgcgctgatggggctgtcgacgctcttattaaaaccgctggatggcattaaacgtccggcgctgatgtccgttttaccgcaccagcaacagggtaaaaccgtggtgctggatctgggcgcaaatgtgggctcagacagtgcgatgctggtgcagtttgctgtaatggggtcggtaatggctgagcatgtgcttggtattgcacggccccgtgtcgcgttgctcaatattggtcatgaagagaccaaagggctggaaacgatccgcgacgccgcggcagtgctgcgagaatcaccgcaaatcaactatattggttaccttgaaggtaacgaaactgctcaccggtaaaacggatgtgatggtctgtgacggttttgtcggaaacgtcacgctgaagactatggaaggcgtggtaagaatgtttctttctctgctgaagtcatcaggggaaggtaaaaaacggtcatggtggcttcagttgctggggcgctggattcagaaacgtctgacgaagcgcttcgggcatctcaaccctgaccagtacaatggcgcttgtctgttaggattgcgcggaacagtgatcaagagtcacggtgcggcaaatcaacacgccttcgctgtggcgatagaacaggcagagcaggcggtgaggcagcaaattcccgagcgaattgctgcgcgccttgatgctgtattagccaggagtgacaaagcctagatgtataccaaaattatcggtacgggcagttatctgccaagccagatccgcactaatgccgatctggaaaaaatggtggagacgtcggacgagtggattgttacccgtacaggcatccgcgagcgtcgtattgctgcgcctgacgaaaccgtcgccaccatgggattcagcgcggcgcaacgcgcccttgaaatggcaggcattgaagcgaacgatgttgggctgattattgtcgccacaacctcttccagccatgccttccccagctctgcctgcatgatccagcaaatgctggaaatcaaagactgcgcggcgtttgacctcgctgccgcctgtgcaggtttcacctatgcactgagcgtggccgatcaatacatcaaaaatggcgcagtgaaacatgctctggtgattggtgctgatgtcctggcacgcgcacttgatccggaagatcgcggcaccatcatcctgtttggcgatggtgcaggcgcggtcgtgctgggtcagagcgaagagcaggggatcatctctacccatcttcatgctgatggtcgctattcacagctgctgacgctgccttatcaggatcgtgcgcatcaggatcagcccgcttatgtcaccatgtcaggcaacgaagtcttcaaggttgccgtcaccgagctggctcacatcgttgatgaaacgctgcaggccaataatctcgatcgtgaaatgctggactggctggtgccgcatcaggcgaacctgcgcattatcagcgccaccgcgaaaaaactcggcatgaccatggataaagtggtcgtcacactggatcgtcatggcaatacctctgccgcatcggtgccaagcgcactggatgaagcggtccgtgatggccgcatcaaacccggacaccttattctgctggaagcctttggtggtggattcacctggggttctgcgctggttcgcttttgattgacaggaacgaaaaatgacgcaatttgcatttgttttccccggtcagggttcacagaccgtgggcatgctgactgaattagcggcaacgtatccgctggtagaagagaccttccgtgaagcctctgacgcgctgggatatgatctgtggcaattagtaagtcagggtccggctgaagagctgaacaaaacctggcagactcagcctgcactgttagccgcctccgtggcaatctaccgtgtctggcagcagcagggcggtgaacagccagccctgatggctggtcacagcctgggtgaatattcagcgctggtttgcgcgggtgtgcttaactttgcggatgcagtcaagctggttgaactgcgcggcaaactgatgcaggaagcggtgcctgaaggcactggcgcgatgcaggcgattattggcctggatgacgcggctatccgcaaagcctgtgaagagagcgcgcagggtcaggttgtctcaccggttaactttaactcgccgggccaggtggttattgcgggtaacaaagaagccgttgaacgtgcgggtgccgcctgtaaagcagcgggcgctaagcgtgccttgccactgccggtcagcgttccttctcactgcgcactgatgaagcctgcggccgataaactggcggtggcgctggagagcatcacctttaacgcgcctgcggtaccggtgatcaacaacgtcgatgtgaaagctgaaaccgatgctgcggccatccgccatgcgctggtccgtcagctctacagcccggttcgctggaccgagagcgtggaagcgatggcagcacagggcgtgacgcagctcctggagatggggccaggtaaagtcctgaccggactgacgaaacgtattgtcgatagcctgacagcggctgccgttaacgatactgcatccctgacggctgcactcggtaaggaataagaggaaaatcatgagctttgaaggtaaagttgcgctggttaccggcgcgagtcgcggcattggtcgtgcgattgcagaaacactggcggcacgcggtgctaaagtggtaggaactgcaaccagccagagtggcgccgatgccatcagtgcttaccttggcgacaagggcaaaggcctgttactgaatgtgactgacgctgactcaatcagcactgttttagagaatattcgtgctgaatttggcgaagtggatattttagtcaataatgcaggcattacgcgtgataatcttctcatgcgcatgaaggacgatgagtgggaggatatcctggataccaacctcacatcggtattccgcctttccaaggcggtcctgcgtgccatgatgaaaaagcgcgtgggccgtatcatcaccattggttccgttgttggaactatgggtaatgcgggccaggcaaactatgcggcagcaaaagcgggtttgattggctttagcaaatcactggcgcgcgaaatcgcgtcacgtggcattaccgtcaacgtcgtggctccaggctttattgagactgacatgacgcgggcactgaacgaagatcaacgttccggtattttggcggaagtttcctgcgggtcgcttaggcgatgctcaggaaatcgccaatgctgtggcatttttagcctctgacgaagcagcctacatcacaggtgaaacgctgcacgtcaacggcggaatgtacatggtctgataaatcacgaaatgatttgctttatttgcggttagaaccgcaaaataacgcaaaatcgtggttcgaccagccgggattttgttgcatctttttcaccattttatacactacgaaaaccatcgcgaaagcgagttttgataggaaattaaatagtatgagcgatatcgaacaacgcgttaagaaaatcatcagtgagcagctgggtgtgaaagaggaagaagtcaccaactctgcatctttcgtagaagacctgggtgccgattctcttgataccgttgagctggtgatggctctggaagaagagtttgatactgagattccagacgaagaagctgagaaaatcactaccgttcaggcagcgatcgactatatcaatagccataaaggctaatgaatatcttcaggcggtcgctcgaccgcctgatttttttgtttgtcccacatagttccctatttcccctccctggaggacgaacgtgtctaagcgtcgtgtagttgtgactggtcttggcatgttgtctcctgtcggcaataccgtagagtctacctggagtgctctccttgccggtcagagcggcattaccctgatcgaccattttgataccagtgcttatgcaacacgttttgcaggtctggtaagagattttaattgtgatgactacatctcgcgcaaagatcagcgcaagatggatgccttcatccagtacggcattgtggccggtatgcaggccatgcaggacagtggtctggttgttaccgacgaaaatgcaagccgtatgggcgcagcaattggctccggcatcggtggtttaggtctgattgaagagaatcatacttcactggtcaacggcggcccgcgcaaaatcagcccattttttgtgccttcaaccatcgttaacatggtggcgggtcatctcagcatcatgtatggcctgaaaggtccaagcatctctatcgcgacagcctgtacctctggtgtgcataacatcggtcatgccgcacgcatcatcgcctataacgatgctgatgtgatgctggcgggtggcacagagaaagccagtacgccattaggcgtcggtggctttggtgcagcacgtgctctctcaacccgtaatgaaaacccgcaagcggccagccgcccgtgggataaagatcgtgacggttttgtgctgggtgacggcgctggcattgtggtactcgaagagtatgaacatgcgaagaaacgtggtgcgaaaatctacgcggaaatcgtaggttttggtatgagcagcgatgcctatcacatgacttcaccaccagaagatgggtcaggcgccgcagcggcaatgatcaacgcattgcgcgatgctcagcttacgccagagcagatcggctatgtcaacgcgcacggcacctccacgccagcgggtgataaagcggaagcgcgggcggtgaaatcggtctttggggcagcagccagcagcgtgatggtgagctcgaccaaatcaatgaccgggcacttactgggtgcggcaggcgcggttgaatcgatctactcgattctggcgctgcgcgaccaggccattccaccgaccattaacctcgacaatccggatgagggctgcgatctcgacttcgtgccccacaccgcgcgtcaggtttcccggtctggagtacaccctgtgtaactccttcggtttcggcggaaccaacggttcattgatcttccgtaaaatgtaatcgttgttgattgctataaaggcccgcgatgcgggcctttttttatcctgcagaatgcgctgaaatcacgagtcacgctcaggggagaaccatgtggattaacgggttaaaacaatcgatgctggccgccagtgaccgcggcctgcagtttggggatggctgttttactaccgccgcggtgcgtcagggtaaaatcgtgctgctggagagccacattcagcgcctcaaagagggctgtgagcgattatggattgatggcgtcgactggcttcagcttgagactgaaatgcgacaggccgcgcaccaacaaacccaggcggtgctgaaagtgattatcagcgccggcagcggcggacggggctacagccggcgcggctgtggtgaacccacgcgaatcgtctcgctggcgccctggccgcaacattacgccgatatacagcagcgtggcgcgtcactcaggctcagcccggtccgtctggcacgtaatccacagtttgccggtatcaagcaccttaatcgtctggagcaggtgatgatcagagctcatcttgaccagacagacgccgacgaggcgctggtgcttgacactgaaggttgggtggtggaatgctgtgcggccaatttattctggcgtcagggctcgcaaattttcacgcctgatctgtcagcgtcgggtgtggatggcattatgcggcgaagtctgatggcgcaacttgcggccgaaggccaggcttgccaggtaataaaaagcgaaccggcgcagctgctggccgccgatgaagtggtgatatgtaatgcgctgatgccggtcctgccggtccgacagatagaagcggtagagtttactgagcgttcgctgtttaatcagttgcgcgcaagctgtgaaaagataatggatgcatcatgattcgaagcaaaaaaatcgtcgtcagcctgctggcgatcgtgggtctcgcggctgtgctgagttactggcaggttaagcggtttgcggccaccccgttaaccctgcagcaggaaacgatctacacgctgcctgccggcacgggccgggtcgcacttgaagcgcagctggaagagcagaagattattccgcacagtatctggtttggcgcgctgctgcgtctggaaaccggaactggcgaccttcaaggcgggtacctatcgccttgagccaaccatgacggtgcgctcgctgttacagctgctggccagcggtaaagaggcgcagttcccggtgcggttcgtggaaggccagcggctgaaagagtggctgagtgagctgcgcaaagcgccttatatccggcataccctgaaagatgatcagttcgccacccttgccagcgcactaaaagtggagcctgagcagctggagggcaacttcttcccggatacctggctttacacggctaacaccaccgatatggcgctgctacagcgcgctcatgatcggatgaaaaaaaccatcgctgaggtgtggcagggacgggcggataatctgccctataaaaccccacaggatctggtgaccatggcctcaatcattgagaaagagaccggcgtcagcgaagagcgcgcgcgcgtagcctcggtatttatcaatcgcctgcgcaccggtatgcggttacagaccgatcccaccgtcatctatggcatgggcgacagctataacgggacgctgacccgcaaagatcttgagacggccagcgcttacaatacctatatcattaacggtctgccgccgggtccgatcgccatgccgggtaaagcctctctgcaggcagcggctcatcccgagaaaaccaactatctctactttgttgcggacggcaagggcggccatacctttacgactaatcttgccagccataacaaggcggtgcaggtttaccggcagacgctaaaggaaaaaaatgaacagtaagtttatcgtcattgaaggcctggaaggcgccggtaaaaccaccgcgcgtgatgccatcgtcgccacgctgcgtgcccggggcattcacgatctggtctttacccgtgagcctggcggaacgccgctggcagaacaactgcggatgctggttaagcagggtattgagggcgagcaggttacagataaagcggaactgctgatgctctatgcggcgcgggttcagctggtggaaacggtcattaaaccggcgctggcgcgcggtgcctgggtgatcggcgaccgccatgatctctcttctcaggcttatcaggggggcggacgtggacttgacgccggtctgatgcagacgctgcgcgatgccgtgttaggcgatttccgccccgatctcacgctctatcttgatgtgacacccgacatcggtctgcagcgcgcccgtgcgcgcggtgagctggatcgcattgagcaggaatcattacgcttctttgaacgcacccgcgcgcgctatctggcgctggcagcggaggatcccaccatcatcaccattgatgccacacaatcactggatgatgtgacagcgtcacttcaggcggcgctggatggctggctggcggagcaggcgtgatgaactggtatccgtggctgaatcagccttatcgccaggtgattggccagcatcaggagaatcgcgctcaccatgcgttgttgatccaggcgatggcaggtatgggcgatgaggcgctggtctgggggatgagccgctggctgatgtgccagcagcgggatggcctgaaaagttgcgggcagtgtcacggttgccagctgatgcaggccaatacccatcctgactggtatcggcttgaagcggagaagggcaaaagtaccctgggcatcgatgcggtgcggcaggttacggaaaaaatgtaccactttggtcagcagggcggcgcgaaagtggtctggctgccggatgccgcgcagctttcggaagcggcggccaacgccttgctgaaaacgctggaagagccgccagccaacagctggttcttcctcagcagccgggatccctcgcgcctgctggccacgttgcgcagccgctgcatggcgctgcatctgacgccgccggacgaaggacaaagcctgctctggctgaagaagcacgctgcgcacgacgaacagatgctgctggcggctctgcgtctgagcgcaggtgcacccggtgcggcgctgagcctgctggaaaacggaccgtggcaggcccgacagaagctctgcgatgcgctgtccgctgcgttgcagcaggacatcctgcaactgctgcctgcgctgaacgccgacgacgcggcagcacgtatcggctggctgctctctttgctgctggatgcaatgaagtggcagcaacatgcaggtcagtggctgagtaatatcgatcgtcaggatgtggtgcagttgctggccggatacttttctgccagcgcgctcaacagcagcatccaggactggatgcgctgtcgcgagcagctattgcatgtggcatcggtgaatcgcgaattattgctgaccgatcagcttctgagctgggcggacaaacagaaacccgcgcttgtcggctaaacctatctgagagtaattatgtttattgtggattcccattgccatcttgatggcctggactatgaaaagaaccatcgtgacctggatgatgtgatcgccaaagcggcggcgcgtgatgtgaaatttatgctggcaatcgccaccacgctgccgggttttcatacccttaaaagtctggtcggcgaacggaaaaatatagcgctctcctgcggtgtgcatccgctgaatcaggaagaggcctatgatgttgaggagtttcgtcggctctctgccgatcctcaggtggtggccctgggtgaaaccgggctggattatcactatcagccagaaacgaaagatcagcagcagcgctcgttccgggaacatatccgtaccggtattgcgctgaacaaaccgatcattgttcacacccgtgatgcccgcgaagatacgctggcgattctgcgtgaagagcaggttgaacgttgcggcggcgtgctgcactgcttcactgaggatcagcccaccgcaacaaaactgctggatatgggcttctacatctctttttccggcatcgtcacattccgcaatgccgagcagttacgtgaagccgcacgctatgtgccgctggatcggatgctggtggaaacggattcgccttatctggccccggtgcctttccgtggtaaagagaatcagcccgcttatacgcgcgatgttgccgaatatctggctgtactaaaaggggtggatttagaaacgctggcagctaccaccacccaaaacttctcaacgctgtttcatatcccgatgagccagctgggcgcctgatcagctattatttcagcctctgtaattaatctgtaacctgcgtatatgaccctgttttttcagacagggtcagctttttatcgccgattactggtgcggatcagtaagaaatttcgtaaagtgcgcccttgtgattgtcgaaacgtgatacccgtcaaagtaacaaatcgggaattattttacccttcgtaataaatcaaaaggcggtcaccgccagcccggcaaagaatcctccctctttgccacgcgcactgcgcaaatatgcactcttactcaggagcttcacgctatgttcaaaaatgcttttgccaaccttcaaaaggtcggtaaatcgctgatgctgccggtatcggttctgccgattgccggtattttgttaggggtcggttcagccaatttcagctggttacctgcagtggtttcgcatgtgatggcagaagcgggtggatcggtgttcgccaacatgccgctgattttcgctatcggtgtggcgctgggctttaccaataatgacggcgtttcggcgctggcagcggttgttgcctatggcatcatggtgaaaaccatggcggtggttgccccgctggtgctgcatctgcctgcggcggagatcgaggctaaacacctcgccgacaccggggtactgggcggtattatcgccggttccatcgccgcttacatgtttaatcgcttctaccgcatcaagctgccagaatatctgggcttctttgccggtaagcgttttgtgccgattatttccggtctggcagctatcattctcggcgtgctgctctcctttatctggccaccgataggttccgcgattcaggagtttctcacagtgggctgcctatcaaaacccggttgtcgcctttggtatttatggcgtaattgaacgtgcgttggtgccctttggtctgcatcacatctggaacgttcctttccagatgcagatcggtgaatacaccaatgcggcaggtcaggtgttccacggtgatatcccgcgctatatggcgggtgacccgaccgcaggtaaactctctggcggcttcctgttcaaaatgtacggtctgccagcggcagcgattgctatctggcattcagcgaagcctgaaaatcgcgccaaagtgggcggtatcatgatctccgccgcgctgaccgcattcctgaccggtatcaccgaaccgattgaattctcattcatgttcgtggcaccgatcctgtatgtgatccatgcgctgctggcgggtctggcattcccaatctgtatcctgcttgggatgcgtgatggcaccagcttctctcacggtctgatcgactttatcgtcctgagcggcaacagcagtaaaatctggctgttcccgattgttggtatcatctatggtctggtttactacaccatattccgtgtactgatcgcgaagctggatctgaaaacacctggccgtgaagagagcagcagcagcgagcaatctaccgcgaccggtacagagatggcgggcaaactggtggcggcgtttggtggtaaagagaacatcaccaacctggatgcctgtatcacccgtttacgtgtcagcgtcgccgatgtggcgaaagtggatcagactgaactgaaaaacctcggcgcccgtggcgtggtggttgccggttccggtgtgcaggcgattttcgggactaaatccgataacctgaaaaccgatatggatgattacatccgcagcatgtaatgatttacagagatgaaaaagccccgcttagcggggcttttttttggccgggattcagaggtaaacgcgcagatactctgtcaggcagagcagggccatcgcctgaccgtagggcatagaggtcagaggaaccgtgcggtagtaatccagatccttgcccattgcggtaccaaaggaaacctgttttaactcgccatcgtcatcaatattggcaatcacgccgcgcaacgctttttctgccacctcgcgatactctgcgggcagataacgcttgcgaacccctttcagaatgccataggcaaacccggcggtggcggaggcttccgggtagctgtgcggatcatcaagcagggtgtgccacaatccgctgctgtgctgacactccctgagcgctttaacctgggtctccagcacctgctgcagaaaacggcgggtagcgtgatgctcaggccagttcatcatctccaggaagtcgggaatgacaatcgtcacccagctgttaccgcgcgcccagcgtgcatcagcaaagttatggcggccgtcaaagttccagccgtggaaccataagccggttttgcgatccatcagatactgggtgtgcagcaggaactgataacttgcttcttcaatccactcatcgcgcttcagcaactggccaattttagccagcgccatcacgctcatcatcagcgtatcgtcccagagctgctgtgggttttcgttgttatagacaatgtgctgcaggccgccctgttcggtacgcggcatctcatacataacccattctgcccagcgctccagcaccggcacccaggccggattcccggtctcttcgtaacggtaggccagcgtcagaaaaggacaaacggtattcacatttttggtcggcgtgccttccgccagacgctgcgtaaaccactcatcaataatggccagcgtctgctggtcaccggtctgctgatagtagtgcagcatgccatacagaccgatgccgtgtgtccattcccaacccgcccagcctttggtatcaatcacccggccatcgtccagccgtaataaaaattcgcctgtctcatcggtgatgttaaccagattctgtgtcagcttttgaatcagctgtaccagtttcgctgcgtggcaacagatgctcgggctggcacaataatttgctgtgtttaacgggaaatacagtcatggtttattcctgtcgttttaaggtcgggtttaaagaagggtttaaagtgggatgtgcggacaatttttccggcgctggcttattacgattaaggaagccaatgttgttgttgccccaaagattttcgtaaggcatgccagccagcgtttctacaattccgcgtgcttccggcgtgatgttttccggcacgatgcggcccgcgtcgcgcatcttcagcgtctcctggcgcagcacagtgtgggtctggagattaagcttaaagcgcagtgacacgataaagccgcaggccagcacggccacagtgcctatgctgagaatcgccaggatagtgtggctgacgccgggtacctgggtcgcctgtccagagacaaagccggagagctgaagcacgataccgaccagcatgactgccccagcctgcgacgcttttcgcgtcagggtcatgatgccggcaaaaattccttcacggcgctgtccggtgatcacctcgtccacatcggcgatataggtataggtgttccatggcacaaagttgatgccgccacgtcccagacctgccagggcggagatcaccaacagcagtgacatgttgtcgttcattccggcataccacaatccagcgtaggagagcgccgccaggccaaacagcacagccaccagacggtaggcgggcgcgggtcccatgcggatgcagagcggaatcatcgccatcacggcaataaactgcagcaccgccatggtccccatcaggctggaggcgacctgagcgctctgcatcagcacaaataccacataccaggtaaagacggcgttaaacacatcctgggcgatatagccgccgaggtacatgccaaggtgctggcggaagatgcggatgcgtaaggttgaagccagctcgacatagagccgtttgagattctgcatcagcgtcagctgctgcttttcctgttctgcacggcgtgactcggcggaaaagtcatcggggtgacgctcccaggtaaaacaccacaccagcgtcagcaccagcgcgcagattaccgaaaacaccaggctggcgtagaagaaggagagaggattatctttgcccagcatccccagcaaaataccgggtaaaaaggcagccagaatggccgacagctgtgccaggccgatgcgggcaccggagaagcgggttttctgtttgaaatcgtcggtcatttccggcaccagcgtttcatacggcaccaggatcatggtgtagacgatatcaaacagcagatacgtgcagagataccaccagaaactcatgtcgctgagccacatcaggctataactgaatacagagggtatgccgagcaggataaaaaatttgcggcggccaaagcgtttgcccagccaggtcgaaccgaagttatcggtcagaaagcccatcagcggactgactatcgcatccagcacgcgggcagcggcaaagatcagcgtggcctgaatcggggttaacccacaaaaggtggtgtaaaaatagagcaaccaggcggcggtcagcgccgtggtgcctgctccaagaaaatctccggaaccgtaggccagatagtggccaagaccaattttacgtgagcgcatgtctgatgctccttgatgtttatggcggtttatccctggtgacgccggtcatctcacccggactggttagcaaagtagaactgacgggtcggctaaaccttcgcaatttggcaagtgctggcgctgaagtggcagtcatacaaagaaaagggtggcgaaattctaatttataaaacagcgtttcattttatggtgtggcaggggcgttgccagcattctgaacagcgtgcgggtcacggagagagggggctgctgcaaaggcaggcgaacaatgcaagaaaagtggtcctgaggttgaaagaaaacaaatttctcccgcatactgattgattaagactcaggctaaaggaattgcaccatggcagaagaaaccatttttagtaaaattatccgccgcgaaatccccgctgatgtggtttatcaggatgagctggtcactgccttccgcgacatttcgcccaaagcgccaacccatattttaatcgtgccgaatgtgctgatcccaacggtcaacgaggcggaagcggcgcatgagcatgcgctgggacgtatgtttactaccgcggcgaaaatcgcccgtcaggaaggtatcgatcaaaatggttatcgtctgattgtgaactgcaatcaacatggtggtcaggaggtttatcacattcatatgcatctgctgggcggtgaaccgctgggaccgatgctctctaactgacctgataacggaagcgtgctatgcgatcctggctgactggcctgccgatcctgctctgcctgacggcctgcagcagtgaaaaaccgatgatcaatacgtcacagtcgctggtgatggagtcctctgtgctgtcggcagggatcattaccgatgaaccgacgctggatgagaacgatggactaaagcgtgccaccagcgtgctctataatcagcgcgaaacaccggttgttgtgcactatcgttactactggtatgacgacaaagggctggaaatcaccccgcaggaaccggcgcagaccgttaccgttccggcgcagggcagcattatcgccacttcgcaactgggtaacctgacggccagcaaggttcgtctttatctctatctttaaggattttctacgtgatacgcagtgttaatcgtaccggagcgctcctgatggcgctcattctgaccggctgtgtggtgaaacagcagcagcctgcaccagttgaaccgactcagcctgtggagccggtgcagcccgttccacaacctgaaccggtgccgcaaccgcagcctgtgccgcagccaccgaaactggtcactatcaactgggatgccagcgtttcagccgctggtggcgcagatgttacaggctgccagcgccgagccgggcagcgtgttgctggtggatcgcgttaaaaacagcaccaacggtgcgctgcaaagcgagaaagcgacggcagctatccagaatgcgctgaataacaacggcaaattcaccctggtttctgctgaccaactggcgcaggccaagcagacgctgggattatcgccggatgacagcctgaactcgcgcagtaaagcgattggcctggcgcgtaacgttaacgctcagtatgtgctttacagcaacgcgcgtggcgatgtcaaagcgccgacgctgcaaatgcaactgatgctggttcagaccggcgagatcatctggtccggcaacggcattgcacagaattaatcccgctttccagcggatgattcagcaggtcaccggcgaaccagaaaagacatcctttacctcgcttgccggtctgaccggacacagccagaagattgtcagcccgcgcggaacttttatcgcgcgggcggcaccgcaaccggctattccgtttgtggatcggcagcgcgaattccgtctgttacgcaaactgcaagccagcggagtggcaccgcagcccgtggcgggccatcatcaggggattatcctgacctggtgcgcaggcgaagcgctggatgaacaccgtttcagccagcagcgtccacagatcgtggcactgctacagcagctgcatcagcagccgctgaccggctatcgtctgcagttgttgccgctgttatggcgctactggcagctcactccacagcggcatcaccgctggttgcgggcgctcaggcgtctgacgcagcagggtgaaccccagccgcttcggctggctccgctgcacatggatctgcatgccggaaatgtcatacaaggtcccgaaggtctgcgtctgatcgactgggagtatgccgccgatggcgacgtggcgctggagctggcggctgtctgtgccagcgatccgcagcaccaggccgagtggctggctgagtatgccgcggcgatgcagctgccgctcaccgcgctggtgcagcaggtcagacgctggcagccctggctgcagttgctgatggccagctggtatcagctccgtgccggtcagcgtgacgacgacacattacaacagctggctcgacagagctgggaacagatttaatcgcgttacgcaggtgcgtttcgctacaggattcatgatatgagatcagatttacccggcccactgatgcttgacgtcgagggttatgaactggatggcgaagagcgcgacatcctgcagcatccgctggtgggcggtttaattttatttgcccgaaattatcatgatcccgctcagctggcagagctggtgcggcagatccgcgccgcctctcacacccggctggtagtggcggtggatcaggagggcggtcgcgtgcagcgtttccgtgacggcttcacccaactgcctgccatgcaatcttttgctgcgttgcacgacctggataccgccggtgaactggcgcaacaggcgggatggcaaatggcggccgagatgatcgccatggatatcgatatcagctttgcgccggtactcgatattggtcatatcagcgccgcgattggcgaccgttctttccatgccgatccggccatcgcccttgatgtcgcccgccgctttattgcggggatgcacgaggcgggcatgaagactacgggcaaacattttccgggtcacggtgcggtgagtgcggattcgcataaagagaccccacgcgatccgcgggacgaaaagacgctgcgtgagcatgacatggcaatcttcagcaagctgattaccgaacaggcactggacgccatcatgcccgcacacgtcatctactccgaagttgatccgctgcccgccagtggttcgccatactggcttaaaaccgtgctgcgtgagcaactgggctttgacggtattattttctccgacgatctgtcgatggagggcgctgcggtgatgggcagctatcctgagcgggcgcagcagtctctttccgcgggctgtgacatgattctggtctgcaatcagcgtcagggcgccatcagtgtactggataacctgatcccggtcgggtcagagcgggttacacagctgtatcatcagggcaggtttacccgcgatgaactgcggggaacgcatcgctggaaaaataatgctcagcaactgagtgcgcttcaggaaacgctggctggctcataaggcgtcgtggtaagcagtgactgcccggcgctatcactaccttgaggattatcatgatcatctatctgcacggttttgattccaacagtccgggcaatcacgaaaaagtgctgcaactgcaatttatcgatcctgacgtcaggttgatcagttacagcacccgccatcccaaacatgacatgcagtttctgctaaaagagaccgataagatgctgacgctttctgacgacgaccggccgctgatttgcggcgtcggactgggcggcttctggtcagagcgcattggatttctgtgcggcatccggcaggtgatttttaatcccaacctctcgccgcaggcgaacatggaagggaagatcgaccggccggaggagtatcaggatatcgcaacgaagtgcgtcagcgattttcgcgagcgtaatcgtgaccgctgcctggccattctctcccgtcacgatgaggcgctcgacagccagcacattgctgaccagctgcatctgttttatgaaattgtctgggatgagacggaagggcacaaattcaaaaatatatccccacatcttaagcggataaaagcttttaaaacattaggttaagcagcaaaggcaccgcaaggtgcctgtttttattacgtaattatctgagttttattttcccgctttgatgtatatcaatattcttatgttctcctcttcccgccatgctattctcccagcagattgcgattttaacttcgccaaccctatgtttcttaaggtttaatttaacctttggttaacttttggttcacaatttgagggggtctttgttgactacgtctgttaagaaaattgttattgtcggagggggagcgggcggcctggaaatggccacgcagctgggccataaactgggtcgtaaaaagaaggccgagattatcctggttgatcgtaaccacagtcacttgtggaagccgctgctgcacgaagtggcgaccggctcaatggacgaaggcattgatgcattgagctatctggctcatgcccgcaatcacggttttgagttccagctgggttcgctcaccgatatcgatcgcacccgaaaagtgatccgcctggccgaagtgctgaatgcgcagggcgaagtgctggtgccacagcgtgaagtggcctacgaccagctggtgatggcgctgggcagcacctcgaatgatttcggtacgccaggcgtcaaagatcactgcatcttcctggataatccgcatcaggcgcgtcgtttccataacgaaatgctcaacctgttcctgaaattctccgccagcgaaggcagggtcgagaaagttaacatcgccatcgtgggcggcggggcaacaggcgttgagctgtcagctgaattgcacaacgcggtgaaacagctgcacagctacggcttcaaaggcctgggacgcgaagcgctgaatgtgacgctggtggaagcgggtgaacgtatcctgccggcactgccaccacgcatctctgctgcggcacatcaggagctgaccaagctgggcgtttcgcgtgctgacgcagaccatggtcaccagcgccgagcgtaatggcctgaataccaaaggcggtgaatttatcgaagccgatctgatggtctgggcggctgggattaaagcacccgacttcctgaaagagattggcggactggaaaccaaccgcatcaatcagctggtggtcaaagagacgctgcaaaccacgctggacgatgacatctacgcgattggcgactgcgcctcctgcgccttgccgggcggcggttttgtaccaccgcgcgcccagtcagcgcatcagatggcctcacgcgccatggacaacattctggcgcagcgtgacggtaaaccgctaaaagcctatgtctataaagatcatggctcgctggtatcgctctcccgcttcagtacggtcggcagcctgatgggcaacctgatgcgcggctcaatgatggtggaagggcgcatcgcgcgctttgtctacatctcgctctatcgtatgcaccagatcgctctgcacggctactttaaaaccggtctgatgatgctggtcggcagtattaaccgggttattcgtccccggctgaagctgcactaagcaacagcaataacgctggctaattaatgttaagcctcctcggttcgattcagagggggctttttttatgtccttgagggtcacacattaagacaaattaaacatcagtttcctgtatgatgattaataagaaatcccggccttaatgccgggattttactttacaggtcagtcaattatccttcattcgctagccggataagcagctgtcccggcccggtgatcacctcgatcttctgcccggtcgtaaatcccagcgcttccagccagcggcctttaatggtgagctgcggcagtgggtttcggctggcccctattaggccggtatcccactctgtaataatgtgctcgcgattcaccagcggcggttgtggacgtgcgggtccctgacttatgatgcgtgtcagccataatcaactccttatcagttggtggtggtcagcgggctgttggtgttccaccaccttcagtccgcgctaaaaaatctctcgttatgtgcttcctgttctgtttttacctgtttaaatatacacctcctgccacgtaaactcgctgaaagctgagtaataaattgcgagctgtctctgaaaacagatagtttttctccggtctggctttcgttcattttttcttcgcagtcagcttgaaagtaacgcttcttggaaaaatgcaggtgttatctttccgaataccttcatttattcagagaggtttaaatagaactgtaacttaatcttttaatgggttatggatatacaggtcagttaataatctgcgttaatggattgtataaggcaggataattttctggatgtatgtgccgtaatggttttcaggggtttggcttttttatggcaactcggtcttgatacctctaattctttttggtctaatagtgccattaagaattgattgataactaaccgccaggatgagtcctgtggttaaattctttacttaacctaaattaaatggccgaagtgccatttaataaggctggcgtttaagtttcacattgactcaggccagcctgttttaaaaaatccgggtatgaatagatgctctccgaccgatctgaacatcaggcgcggagcgctacatgaaattcctgtccgatacaggcggatagataaaaaattatcctgtccgtcgggtattggtgattcagggaacgaagtcctgcgttaagcgcagggaaataatgttaaattatgaaaaggaattaattacatgacttctaaaatgacgatgctggcattactgtgtggcggtctgctcgtgggcagcaatgcactggctgataatcacacggtctcggttggttatgcgcaaagcaaagttgaagactttaaaaacatccgcggtgtcaatgttcagtatcgctatgaatggaattctcctctcagtgtgattggctcattcagctacatgaaaggcgatgacagttattccgagcagaatgattattttgacggtcttgagaaatataatgaaaaaattgaagcgaaatattattccctgatggcgggtccggcataccgtattaatgactatgtcagtttctacggcttaattggggtcgcgcgtaccaaagtagaagataaagccaattaccagtcacagtacgcacagtattcgggttcttacagcgaaagcaaaacatcctttgcctacggtgcgggtgtcgtggttaatcctatcagcaatctctctgtgagtgttggatatgaaggtactcgcgtaaaatataacgaagatgttgccatcaatggttttaacatcggcgttggctatcgtttctaagttgcctgaagcctgtaaccccggccgtctggctggggttatttattcctgcgccgggtaagtgaggggcagacggcgaatttgctttaaatgttttcatgtgcaaactgataacgtgactgccggctttacttccgattagttattattagctgattgattctactattattatccataattccctgaaactgtcagtgcggctttccagcctcagaactctcctaaaaactggtcctgatagcaaagtgaccaatttcctccatttatctgatgttgcattttcggtccatctgtaaaacttcatctcaacaaacacggcgcgtcgcgcacgtcggttatacctcagttaacgaggatgctttagcagcaggattgcgcggtaacacttttcaggaggaacttcctgtgaataaatcaatgttagcgggtatcggtattggtgtggcagcagctctgggtgttgcagccgtagcaggcatgaacgtgtttgatcgcggtcctcaatatgctcaggtactgtctgcaacgccaatcaaagagagcattaaacagcctcgtcaggagtgccgtaatgtcactctgacccaccgtcgggccgtgcaggatgaaaaccgtcttgctgggtctgtattaggtgcagtggcaggtggagtgctgggtcaccagtttggtggcggtcgcggcagagatgtggcgacagtagcaggtgcggtagcgggtggttatgccggtaatcaggtccagggcggactgcaggatcgggatacctacaccacaaccgaacagcgctgcaaaaccgtttacgacaaacaagagaaaaaactgggatatgatgtgacctataaaataggcgatcagcagggtaaaatccgtatggaaaatgaccccggcacgcgtattccactggatcgcaatggtcagctggttctcaacggcgatcaggcgtaattgggcaaagctttgccgctcacgcggccacacagcacaacgtaatacagcagtaattaaaaaggcgcatctcaggatgcgcctttttttgcggcaaactaaccggcgctttaccggttagatcaccaacgcacgggcagggtgttacgcctgccgttgagccagttgcgaaacgaatccctgcacccactcaagccgcacttttctttccgatagctcacgggtaaaccggagtcgcgtcggaccgtccagcttccactgctgaggctctttctgcagcaggcctatcagccatgccggatccacgttgttcttcggcgcaaaatcgaaataaccgcctttgtcgctggcttcgatcttacgcagacccacagcgcgggctttcagccggataatcgccacatccagcagattacgcgccggatcgggcagcaggccaaagcggtcgatcatctcaaccttcagctcctgcaactcctcttcagcctccgcgctggcgatgcgtttatagagtgaaagacgggtactgacatccgggataaaggtctcgggcagcagggcgggcatccgcagctccacctcggtctggttgctggtgagatcttccagtgacggctcgcgacccgctttcagcgcctcgaccgcattctccagcagctccatataaagcgtgaagcccagcgtctccatctgtccgctctgctcatcacccagcagtttcgccagcaccgcgaatctccaggtcatgcgttgccagggcaaaaccggctcccagatcttccagtgaagcgatcgcctccagccgcttatgcgcatcggcggtcattgacttcggatgcggtgttaacagccaggcataagcctgatgatgcgaacgcccgacgcgaccacgcaactgatgcaactgcgccaggccaaagtgatcggcccgctcaatgataatggtattggcggtcggaatgtcgataccggtttcgataatggtggtacagaccaggacgttgaaacgctgatggtggaaatcgttcatcacccgttccagatcacgctcacgcatctgaccatggccaatcgcgacacgcgcttccggcaccagttcgctgagacgctgagccgctttctcgatattttcaacgtcattgtagagatagtagacctgtccgccacgcagaacctcacgcaggatcgcttcgcggatcaccagatcgtcaaattcacggacaaaggttttcaccgctaaacggcgggcaggcggcgtggcgatgatcgagagatcgcgcatgccgctcatagccatattcagggtgcgagggattggcgttgcggtcagcgtcagaatgtccacatcggcgcgcatcgccttgatgcgctctttgtgacgcaccccgaaacggtgctcttcatcgacaatcagcagaccgagatcgtgccatttgagatcgctcatcagcagcttatgggtgccgattaagatgtcgatcttgccatcgctggcctgttccagcacctgcgcctgctctttggcagtacggaaacgggaaagcatctcaatgcgaaccggccagttggcgaagcgatcgcggaagttgtcgtaatgctgctgtgccagcagggtggtcggcaccagcacggccacctgtttatggttctcaatcgccagaaacgctgcgcgcatggccacttcggttttaccgaaaccaacgtcgccgcacaccagacggtccatcgccagcggctcgcacatatcactcagcaccgcgttgatcgcctgcgcctggtccggggtggtttcaaacgggaagctttcgcagaacagctgatactgctcgcgattatgcttaaaggcaaagccggttttggcggcgcgctgagcatagatatccagcagttcagccgccacatcacgcactttctcagccgctttctgccgtgcgcgtgaccaggcatcgctgcccagtttgtgcagtggtgcattatcgtcagcaccgcccgcgtagcggctgatcaggtgcagcgatgaaaccggcacataaagtttggcgtcgttggcgtaagagagcatcaggtattccgcctcaatgccgccggcttccagcgtggtgaggccgatataacgacccacaccgtgttccagatgcaccaccggctggccgggatgcagctccgccaggttacggatcagaatgtccggattgatagtgcgacgggtatcctgacggcgacggctgacgcgtttcgcccagcaaatcgctttcgcaaatcagcgcccggttgccctgggtatcaataaaaccgcgctcgctggcgccgatcatcagtcgaaaacgctcttcgccgacctcatcgaagcggtgcaccggctgaggacgcagtttaatccgggccagcagatcctgcaggctctcacggcggccttcactttcgaccgagaagaccacggtgccgctgaaggtctcaataaactgacgcagatgatccagcggcgcttttgcctgcgcctgaacggtcagatcaggcagcggggtataaccgaggttggtattcgcggctttggcgggcagcacctcattggtcatctggatgcgcggccaggctttcagctcccccattaatgcatccggacgcagccacagggtggccggttccagcagtggacgcatcggatcaacgcggcgattttcataacgcgcctcggcatcctgccagaagcggctggcgctgccttcaagatcgccgcagttcacaatcagggtattatccggcagatagctgaacagactgggtaacggctgctcaaaaaacagcggctgccagtattcgatgcccgctggcagcgtgcctttgctgacctgctgatagacatgctccgactcacggcgcacatcaaacgtttcacgccagcggctgcggaacagctcaatggcagctttgtcgctgggaaactcatgcgcaggcagcatgttaatttcggggaccgcttccagtgtgcgctgactgtcgacgtcgaacaggcgcaggctgtcgatctcatcatcgaaaaagtcgatgcggtagggctgatcgctgcccatcgggaacaggtcgagcagggcgccgcgcgtggcgtattcaccatgctccatcacctgatcgacatggcgataaccggcctgctcaagctggtcgcgcagccggtcgcgtgacagtttttgtccctgcttcatcaccagcgcatggccgtgcaggaaactgtgcgggcagacgcgctgcatcagggtgttgaccggcatgatcagcataccgcgctgcatcaccggcagctggtagagggtcgacaggcgggcggagataatatcctgatgcggcgaaaagctgtcgtagggcagcgtttcccagtcggcaaggtgcgccaccggcagatcggtaaactggcggatttcatccagcagacgcagagcggtttgggtatcaggtgtaatcatcaacaccggaccggcatgtcgttcggtaatgctggcacactccaccgcgtgcgccgcgcctatgagctggccgagctgacggtgatcgccggatttaacgggcagggtataacgagtctgttcgggcatgggatctcggggttgctccatttttccaggacgtaatcattccatattatgtcagggggatcacctctgcggcacaattttcctgccgcgccgcgctgaaccaggggatcggtcagccattaccgggcgtcagcggtaatcgtgcggataaagagaggatagacggagtctggcaagggatcagaaaaaaccgccgtcgccatgcagcgacggggttaaacgggcattttattttatggattgctgtgtgtaatgcatgcgtgggcggtcgatattcgcccaggataactcctgctcaggatgatagctgaggttaccgtcgtcccactttacgtagtagccggctggtgcgtttccctgctcaaagacgttgatgatttcgcctctgatctccccggatttatgtttaacgatgctgcctttgggaaatttcaacatggtcgctacctcatactgcccggcaataaatcacccgtgatcatggtactgattgtagtctacctccctggacgctgaataatcagccaataagcggcggctttatcggctattccgctgctttggcgcggaatgtgacgcatccggatgcaactttgctgccgactcagagggttagaggtttcataaagccagccgctcctttatcatcccactacctattttcaggcaacggcttactggattccatgtatcaacctgtcgcgctatttatcggtctgcgttatatgcgcggacgagcatcggatcgcttcggtcgctttgtctcctggctctcaacgattggcattacgctcggcgtgctggcgatggtcaccgtgttatcggtgatgaacggttttgagcgtgaactcgaaagcaatattcttggcctgatgcctcaggcgctgatcaccagcgacaaaggcagtctcaatccacaacagcaacccgccagctccctgaatctgcagggtgtcagccgtatcgcgccgctgaccaccgccaatgtggtgctgcaaagcccgcacagcgtctccgttggcgtgatgctgggcattgagccggctgaaaaagatccgcttacccctttcctggtcaatacccggcagagcgtgctgcaggccgggcagtataatgtcatcctaggcgaacagctggcatcccagcttggcgtaaaacgtggcgatcaactgcgtctgatggtgccgtcggtcagccagttcaccccgatgggacgcgtgccaagtcagcgtctgtttaccgtagtgggcacctatgccgctaacagcgaagtcgatggttatcagattctggtcaatcttcaggatgcgtcgcgcgtgatgcgctatccggccggtaatattaccggctggcgactgtggctggataaaccgctgtcggtcgacagtctgagtcagcagacgctgcctgcgggcctggtctggaaagactggcgtgagcgtaaaggcgatctcttccaggcagtgcgtatggagaagaacatgatgggcctgctgctgagcctgatcatcgccgtggctgcctttaacatcatcacttcgttaggcctgctgatcatggagaagcagggcgaagtggcgatcctgcaaacccagggcctgacgcgccggcaaatagtggcggtgtttatggtgcagggtgccagcgccggtattatcggcacgctgctcggcacgctgctcggtgtcttgctggccagccagctcaacaacttaatgccggtgattggcctgttccttgatggtgccgcattgccggttgatattaatgtgtggcaggtggtcaccatcgccctcagcgccatgattgtggcgctgttgtctacgctctatccttcgtggcgcgctgccgccgttcaacctgctgaggctttacgttatgagtaacactcctttgttgcagtgccgcgacctgtgcaaacgctatcaggaaggcagcgtgcagaccgatgtgctgcgcaatgtggctttcagcctccagcccggtgaactgacagcgattgtcggcagctccggttccggtaaaagtacgctgctgcatctgctcggcggcctggatgcaccgacatcgggcgacgtggtgtttgatggccagtcactgaatgcgatgtcctcgtcggccaaagcggagctgcgtaaccgcgagctgggctttatctatcagttccaccatctgctgccggacttcagcgcgctggagaacgtggcgatgccgctgctgattggcaaaacggctaaaacggaagcacaggatcgcgcccgtgagatgctggccgcggtcgggctggaccatcgcgccgcgcaccggccttcagaactgtcaggcggcgaaacgccagcgcgtggcgattgcccgggcgctggttaaccgcccacggctggtgatggcggatgagccaaccggtaacctcgatgcacgcaacgccgacgccatttttgaattactgggcgaactgaacgtgcgtcagggcaccgcgtttctggtggtgactcacgatctgatgctggcaaaacgcatgacgcgtcagatggagatgcgtgatggtcagttaagcgatcagctcaccatggcaggagcggtgtaatgggttcgtcgttatccctgttgctgggcctgcgctttagccgtggccgccgtcgtggcggcatggtgtcgctgatttcggtgatctccaccatcggtattgcgctgggcgtggcggtgctgattatcggtctgagcgccatgaatggttttgagcgtgagctgaacaaccgcattctggcggtggtgccgcacggcgagatcgaggcggtcaatcagccgttccagcactggcagtcgatgattgccccgattgaaaaggtgcccggcattgcggcggcggcgccttatgtgaacttcaccggcctgattgagagcggcgcccggctggaagcgctgcaggtaaagggcgttgatccggcacaggagccgcgcctcagcgccctgccacagtttgtggcagataacggctggtcctcttttgccgccggtaagcagcagatcattctgggcggcggcattgctaaatcgctgaacgtgaagcagggcgactggatcaccatcatgatccccaacaacgatggtgataacaaactgcttcagcctaaacgtatccggcttcaggtcagcggtattctgcaactgagcggcatgctcgatcacagcctggcgctggtgcctctcgccgatgcgcagcactatctggagatgggtgacagcgtgtccggcatcgccctgaagatgaccgacccgttccaggcggtcaaactggtgcgggatgccggtgaagcgacccgttcctacgtctacatcaagagctggattggcacctacggctatatgtaccgcgacattcagatgatccgcgccatcatgtatctggcgatggtgctggtgattggcgtcgcctgctttaacattgtctcaacgctggtgatggcggtgaaggataagagcagtgacattgcggtgctccgtaccctcggtgctaaagaccggctgatccgcgccatcttcatctggtacggtttgctggcaggcctgctgggcagcgtcagcggcgtgatcgcgggcgtgctggtggcgctgaatctgacctcactggtgcgcgggctggagtcggttaccggtcatcatctgctggcgggtgatatctacttcattgatttcctgccgtcggaactgcactggattgatgtgttctcagtattgattaccgcgattctgctgagcctgctggcgagctggtatcccgccagacgcgccagccgcattgacccggctcgggtattaagcggtcagtgaaaaaatgcggcgcgaatcctttcgcgccgcatctgtttaagacctttgctgttgggcgcggccctcagcaaccgttactatcgggtgatgttaacccggaatctgtttagagcggctcgccgcagctgctacgccaggagattttatgcgtacaccacgtcgccgcatacgacttgcccgcctgaagaaaacccggagaaaagtgcatcagcgctttcgccagcgcatatttgagcgcgatcgtcaggccgaaactggccgcccatcctcagccgcatgttgtcgtgctgaccggcgcaggcatctcagcggagtccggcatccggaccttccgcgccgctgacggcctgtgggaagagcaccacgttgaagatgttgcgacgcccgaaggatttcagcgcgatcccgcgctggtgcagcgcttctacaatgcgcgccgccagcaattgcaggaggcagagattcagcctaatgcggcccatctggcactggcggagctggaacaggtattaggcgataactttttgctggtcacacaaaacatcgacaatctgcatgagcgtgccggaaacagccgggtgctgcatatgcacggtgaactgctaaaagtgcgctgtgtcaccagcggtcaggtcattgagtggaccggtgatattaccccggacgatcgctgcacctgctgccagttcccctcggcgctgcggccgcacgtagtgtggtttggtgagatgccgctgggcatggagcagatttatcaggcgctggaacaggccgattactttatcgctatcggcacctcaggccatgtctatccggccgcgggttttgtccatgaggccaaactgcagggcgcgcatactgttgagctgaacctggagccaagccaggtgggcaacgaatttgccgagcgacattacggcctggcgagcgaagtggtgccggagtttgtgcataagctgctgcgcgcgctttataagtaagcaggggcggctatggccgcctcgccgtttcttgcccgtcatgctgattccagccgcccggtatttatcagcattgcgaggtttgccgcaacaatctcgtaatcagccgtttttttcgggcttattgctttcccaaaggttatcgacagcgctaacctgtctgcgaatgattttacgcaacgttgtaaccggctggtctgttaataataccggatggcacttttaaaggatgggatatggaacagttacttgagcgctttttaagttatgtggccgttgagacccaggctaagccgcaggcgcgccaggtgcccagcagtgaagggcagtggacgctggcgcgtcagctgcaggaggagttgctggcactgggttttgtcgatgtctccttaagcgatcactgttgcgtcatgggcacgctgcccgccaatgttgactggccgacgccagtcatcggtttcatctctcacatggatacctcgccagactttacggcgaaacatgttaatccgcagatcattgaaaattatcgcggtggggacattgcgctgggtaacggcaacgaaattctctcgccggtgatgttcccggtgttgcacaagctgattgggcatacgctgattactaccgatggcaaaaccctgctgggcgcggatgataaagcgggtatcgctgagatcatgacggcgatggcgcaactggctgcgagcgatacgccgcacggtgcgatccgcgttgcctttacgcccgatgaagagattggtcgcggcacttctcactttgatgtggaaggctttgccgctgactgggcctacaccattgatggcagtgatctgggtgagttcgaatatgagaacttcaacgctgcttcggccaccgtcaaaatcatcggtaacaacgtgcaccctggctccgccaaaggggtgatggtcaatgcgctggatctggcaaaccagtttcatgccgcggtcccggccagcgaaaaaccgcagtatactgacggctatcagggcttctatcatctgcatcagatcaaaggcagcgttgaacacgccgagatgctctatatcattcgtgacttcgaaacggagagttttgaacagcgtaaacagacgctgctgcagattgccgcagagatcaacaaaaccctgcacccggactgttcggtcaccgtcgagatcaccaacagctatcgcaacatgcgtgaaaaggttgagccgtttcccgcacatcatcgaactggctttacaggcgatgcgtgactgcggcattgagccggtagtgaaaccgattcgcggcggtacggatggatcggcgctgtcctggaaagggctgccttgcccgaacatctttaccggtggctataactatcacggcaagcatgagtttgcttcgctgaatatcatggcgaaatcggtggaagtgattgtgcggctgtcagagctggcggcgcagaagaagaattagacccgcaggcacaaaaaaggctctctgccacggcggcaagagagcctgattcagtatcagctcagattattcgtcgccgaagtaccagtatccggcattgaccaggtcggcgatctgcgccagtaccgacgggtcatccagcgcatcgcccagatcgtccagtgtgatgcgatagtggcgcgccaataccgccatcacctcgggatgtgaacactcaacccgctcaccgttgacatagaccgcatcgccaatcgtcaggacacgcaggccacctaaccggctcagggtatcgccctgttgcagcgcatcataaatttcatcaggctggtaaggcggttccggtggcgcgacatcgagttcgtgacgtgactgggaaatgaattcgccaaaccactgagcgaactgctccggctgattgaccacatccagcatcaactgacgtacgccttcaatctcctgcggcagaatctgcgacgggcaatcacgtgcaggcacatccggatcgctgaagcgcaggctgcccagctcattagccagcgcgtaatccgcaaagccgctgattaactcgcgtccgctgggggcacggaaacccacggagtagttcagggcgttttccagcgagtagccttcatgcgggaaccccggcggaatatagagaatatcacccggctccatctcttcatcgatgatggcgtcgaatggctcaacctgcagcagatccggatgcggacagtgctgcttcagcggcaccttttcaccgacgcgccagcgacggcgaccggccccctgaataataaagacatcatactgatcaaaatggggaccgacgccgccgccagggacggcaaacgacaccatcaggtcatcaacacgccagtcaggcaggaaacggaaagggcgcatcagtgcggcagaggcttcatgccagtgattgaccgcctgtaccagcagcgaccagttgttttcacccagatgatcatagctctcgaacgggccgtggctgacctgccatttgccatcctgatggctgaccaggcggctatccacctcattttccatcgccagaccggccagttcatccggtgaaagaggatcgacaaagtttttaaaaccacgcttcagcactaccgggcgtttctgccagtaacgctgaataaaatcgggccagttaatatcgagctgatagtccataaaagggttccgcttagggctgtaaatgccagcaagtataacagccctgagggttttctactcgcggcgatgttcgacttcctggcgctgaaagaccacttccatgcgtgttccgccgagtgcgctaccggaggcgatgacgttgccctcatattgctcaagaatatcacgcaccaccgccagacccagtccctgaccgggacgcagggtgtcggcgcgctgaccccggacaaacactaaatcgcgcttactctcgggaatgcccggaccatcatcgtcaatatagagatggagtgcattttcgctctgaaaagcactgatttcgataaattccaggcagtacttgcaggcgttatcgagcacgttgcccagcacttccataaagtcattctggtcgccaacaaaggtcagctccggtgagatatccagcgaaatcgccacgcctttacgctgatagactttattcagggctgagcagagcttgtcgagcagaccggaaacggaatgcagatcgcgctgcagcgggttgtgatcggcctgcatactggcgcgatgcagataataaccgacctgctgcgagatacgactaatctgctccagcatcaccggctcagcctgttccaccgtcagtttccttgccgttgcgcagcgagcgcagggtgctctgcaacacggccagcggcgttttcaggctgtgggtcaggtctgaaagcgtggtgcgatagcgggtatagcgttgtcgctcattggtcagcaacagattgaggttacgcaccagactgcgcagttcctgcggcggattatccgccagattttcgcgctgactggtctccagttcgcgcacctgctgcgtcagcgcgccaatcggccgcagactccagtgcgccgccagccacagcaacggaatgatcagtatcaggttggccgccagcacatagctgaaccacgaccagaccacatcagaatgctgcaactcctgcgggatagagtcgaccaccacaatggtgagtgcgggcagattcgtggtggcatcgtaacggttaacggcgaccgaatgggtaaaggtatcgttgctgtcattgtcccagtcgttgagtcgttgctgagcattcaggttattgcccatcgccaccatgctggtacggttactggtatcaatctcgtagaagtcaggcttcagcaaccattcacggcggatcttcttgcggatctccggcacgtcgcgttgctgccacaacagcttgccgtgctcatcgtaaataaacaccagcgtcgggaagttgagcgtcatccgttccggctgggcgatggtgagtttgttgtcatgccattgcgccagcgtaaagaacaggttgctctcgccgcgcatcacgcggtaggtgtttttatcgaaactgaccacatagccaatcaccgccaccatgccgtaggagagtgagaggaagaggacgatcgctgcggaggccagcagaaagcgggcgcgcagcgaaatagggcgataacgattaaaccaggacatggtcagagatcaaagcggtagccctggccacgcacggtggcgatcacgtcagtaggatgcaacgccagaatttttttgcgcagacgtcccataagaacgtcgatggtgtggctttcacgcagttcagcgtcaggatagagctgcagcatcagcgagtctttgctcaccactttgcccgcgttacggatcagcgtctcgacaatggtgtattcaaaagcagtgagcttcaccggctgatcattgaccgtcagttcacggcgggagagatcaacctgaaacggggccatatcgatgatttgcgaggcatgtccgctgttacgacgcatcagcgcctgcaggcgtgccgcgacttcttcaatatgaaatggcttggtgacgtagtcatccgcaccggcttccagcgcctcaactttggcctgccagccttcacgggcggtcagcaccagaatcggctggcgcacggcatcgctgcgccagcggcgaatcagagacataccatcttcatccggcaggccgagatccaccagcgcgatatcgggcagatgttcccgaagaaaatagtcagcttctttggcgtcttcggcggcatcgacctggtggcccatgtcacgtaactggacggcgagatgatggcgcagcagggcattgtcttcaacaaccagaacacgcataggaattccttacactctgtttgagtcaacctgcagaaagtatacgcgaaatgtattaaacaagatgttaacgcagaccggactgggccggcctgcggcgggcattatttcagatcgtcaaccatctggatagcgcggccaatatagtttgcaggcgtcatctgcttcagacggactttttcctcttccggcagcgccaggctgtcgataaaggcctgcatgccggcggcatcgacgcgtttaccgcgtgtcagctccttcagcttctcataaggcttctcaatgccgtaacggcgcattaccgtctggatcggttctgccagcacttcccagttgtgatccagttcatccagcagacgatcgcggttcacttccagtttcgagatgcctttcagcgtcgcctgataggcgatcagcgcataaccgacgcccacaccgaggttacgcagcacggtggagtcggtcagatcgcgctgccagcgtgagaccggcagcttgctggccagatgctgcattaccgcgttcgccaggcccagattgccttcggagttttcgaagtcgattgggttcactttgtgcggcatggtcgacgagccaatctcgcccgcaatggtcttctgtttgaaatggttcagcgctacataaccccagatatcgcgatcgaaatcgatcaggatggtgttaaagcgggcgatgcagtcgaacatttcggcaatatagtcgtgcggctcaatctgcgtggtgtaagggttccatgtgatccccagcgaggtgacgaagttctcgctcagcgcatgccagtccacttcgggataggcggcaatgtgggcgttgtaattccctacagcgccgttgattttgcccagcacctcaatctgtttcagctgacgtaactgacgctccagacggtaagcgacgttcgccatctctttacccatcgtcgacggtgtagccggctggccgtgggtgcgggagagcagcggaatgtcacgatattcgctggcaagatccttcacagcggtaatcagctgctgccagtaaggcaggataacgtcacgacgggctgtttccagcatcagggcgtgcgacaggttgttgatatcttcagaagtacaggcgaagtggataaattcagaaacagcatgcagggcagggacgtcggcaactttctctttcaggaaatactcaaccgctttgacgtcgtggttggtggtgcgctcaatggttttgatgcgcgcggcatcttcttcggaaaaaccggcgacaatcgcatcaaggaaagcgtttgcgtcggcatcaaatgcaggaacttccttgatctctgcggtcgcggccagtttttgtaaccagcgaacttcaacctcaacgcggaatttcagcaaaccgaattcgctgaaaatcgcacgcagcgggctgactttatcgccgtaacgaccatcgacaggtgagacggcggtcagagaggataattccatcagtgcaactcctgaatcatttagcagtgttttgccgcaccgacttagtaagtcagtggcagccgggataagagggttttcgcttcacgcagcaaacgctgacgcgagaacatcagttgcagtcggccaccaccgacctgctgccacaatacggcagcacggataccggctaacagggtggcgcgcactttactctgtacctgcgtattctgcagtaccgcaggcgaaaccggtgacctgaatacgcgggccaagcgggctgatcacatccacatagatggcagccatcgcgctgagaatggtgtctgattccagttcataatgcgccagctggcgatccagctgagtgatgcgctgggccagcgtcgccatggccgttttactggcgctgagcttgcgctccagcaccatcatgctcagggtgtaacgcgtcagctctgcacctgcgccctgacgactgctgctgttcagcaccgccatcagcgtttcaagtccgaggcgcaggttggcttcattgttgccaaacaccgccagcgttgagccaggattgaggtccagtacgctgcgcagcgacacggtcagcgcctccggctggcagtgaccctgctgagccagctgctgcaccagatgggccgactgacagatgcccgccagcgccagcgtaatttcctgataatttttcgccacggttactcctgtttacgcgtcatcaatgcgggctgagcccgcttactccgccactaacggcagacgctgttcgataataccgccaccgaggcagacctcaccaaggtaaaacaccgcagactgacccggcgtcactgctgcaaccggctcgtcgaaacgcacctcaatccgatcgtcgccgtgtgggataatctcacagggaatatcggtctgacgatagcgggttttcacggtgcagcgaagcggggcggtaatcggctggcgatcaacccagtgcagctgctgcgcaatcaggccgacggacatcagacgcggatgatcgccgccctgggcgacaatcaggcggttacgcgccacatctttgtcgaccacataccagggatcatctttgctctctttcaggccgccaatacccaggcctttacgctgtcccagagtatggtacatcagcccctgatgttcaccgacgatctggccttcggtggtttctatttcgccaggctgagccgggagatagcgcgccaggaagtcgcggaatttgcgctcaccgataaagcagatgccggtcgaatctttcttcttcgcggtgataaggtccagctgttcggcaatgcggcgcacttccggtttttccagctcgccaaccgggaacagactttgggcgatctgctggtggctcagggtatagaggaagtagctctgatctttgttgccatccagaccgcgcaacagctggctctggccagccacgtcctgacgacgcacgtagtgaccggtggcgataaaatctgcgccgagatcctcagccgcgaactccaggaacgctttgaatttgatctctttgttgcagaggatatctgggttgggcgtgcggcccgctttgtactcttcgaggaaatgctcaaagacgttatcccagtattcagcggcaaagttaactttgtgcagcttcatacccagcttgtcgcacaccgcttgcgcatccgccagatcgtccgcggcggtacaatactcctcgccatcgtcctcctcccagttcttcatgaacaggccttcaacctggtaaccctgctgttgcagtaaccaggcggaaacggaagaatcgacgccgccggacataccgacgatcacttttttctggctgttgtcagacatgacacgctcgcattacgataaaaaaacaggcggcgcattctatcatgcagaaggcaggcgcgcaccctcgtgaaacggccaccggaatgggctgaccagatgtagcgggtagcgcgtgccctgttgccacaggcgtacgctttccgcgaccagcggcgaacgcaggttagaggcagtgagaatctgcgctggcggcaaccaccagcagcaatcgatgtcgctgtcctgcggctgggttggcgctttttccgcaagatccacgccaaacagaaaacgcacaaaaggcgtactgtcgggcgcgatccactggtttatcgcgatgaaatagtgcatcggcgtggcgatgccggtctcttcatagagttctcgctctgcggcttccagcagagtttcatccgcttcaagatgcccggcgggctggttccaggtggggcgaccgttgatcgtctcttccaccaccagtaattcaccttctgcctgaaccagacaggcgacagtaacatgaggtttaaacatcacttctccgcaattgttaacctgaggttataaaaaaccggttttcagagcgcactttcactgagttcgcgccacgcgcccggagccagatcgtccagcgaataactccccatcgcgtaccgaatcaatcgcaatgtgggaaagccaatgtgggcggtcatccggcgaaacctgtcgatttcggccttcatacagcgtgattttcagccactgcgtcgggatgtttttacgttcgcgtataggtggctgacgtggccagagccactcaggttcagccactgtttctaccccagcgggcagcgtcaacccatctttcagattaaccccatcccgcaaaggctgcagatccgtctcctgtggctcgccttccacctgcacataatagatcttacctgtgcgtttgccgggctgagtcagcgcagcctgcagcgcgccgtcgttggtcagcaccatcaatccttcgctgtcgcgatcgaggcgacctgcggcataaacctctgcgacgctgacaaaatccttcagggtacgtcggcccgcttcatcggtgaactgcggtaacacgtcgaacggtttgttaaacagaatcacgcggcgcggagccgcagggcgggcaggggaacgccgcgcatcacgcgtcgggcggctgaatcgtttatcctggtgaattcgttgagaagtttttcgcatgggctttgcagtcagaaacattcggcgcattataacgtgaaattgcggtgattggcgtggcggaaatattcaagtagtattgacgcgcatcttacaaatcattaacaaacgcccaggagaggttaatggaaagcaaagtagttgttccggcggaaggtcagaaaatcaccctgaatcagggcaagctcacagtgccaaacaatccggtcattccttacattgagggtgacggtatcggtgttgatgtttccccggtcatgctgaaagtcgtcaatgcggcggtgaagaaagcctacaacggcgagcgtaagatctcctggatggagatttacaccggtgagaagtcagttgaactctacggccaggatgtctggctgccacaggaaactctcgacttaatcaaagaatatcgcgtggccattaaaggcccactgaccaccccggtcggcggcggtattcgttcactgaacgtggccctgcgtcaggaaacttgacctctacgtctgcctgcgtccggtacgttactacaaaggcacgccaagcccggttaaacgtcctgaagagaccgacatggtgatcttccgtgaaaactccgaagatatctatgccggtatcgagtggaaagcgggctctgccgaagcggacaaagtgatcaagttcctgcgcgaagagatgggcgtgaagaaaattcgcttccctgagcagtgcggtatcggcgttaagccgtgttcagaagcgggcaccaaacgtctggtgcgcgcggcagtggaatacaccatcactaacgatcgtgattcactgaccctggtccacaaaggcaacatcatgaagttcaccgaaggctctttcaaagactggggataccagttagtgaaagaagagttcggcggcgaactgatcgacggcggcccgtggatgaagttcaaaaacccgaacaccggcaaagagatcatcgttaaagatgtgattgctgatgcgttcctgcaacagatcctgctgcgtccggctgagtatgacgttatcgcctgtatgaacctgaacggtgactacatctctgacgctctggcagcgcaggttggcggtattggtatcgcaccaggcgccaacatcggtgacgagtgtgcgctgttcgaagcgacccacggtacagcacctaagtatgcaggtcaggataaagtgaacccaggttcaattattctgtccgcagaaatgatgctgcgtcacatggagtggttcgaagcggctgacctgattgttaaaggtgttgaaggcgctatcgctaacaagaccgtgacttacgatttcgaacgcctgatggatggcgctaagctgctgaaatgttcagagtttggtgacgcgatcatcgaaaatatgtaatcggctttacgtaacatatagccagcacgaatgtaaaaatcgtgttggctttttacttcccgctttctttcctcaaaatctccccaaaacggtttataaaatcaccttcacgcagcaaccacaatccaggctttgccgcgatcatcgttatagcgattactcatctaagcgcttattgctttcgcaccgtgctgtttaagacatttactccgtgagagtgctgctaaatcatttcccgctgactggcattttactctctctgcaaattgaattgtctgatgccacggtaaaagagtgagtgaacgcatatctgtcatccaccctgtcacgcctgatttgttaaacgaccctctgttaatctctttcagtaccagttaagcgcccggcattaaatgtgtcgggccacgttatttgctccttacagctgatccatttttgtaacctgtaccacaaaaaaatagagttacgcatgatccggttgccgcagacgtgtacgcttctgccgatacagagggagagcattatggatgatgaagcggtaagtgatgctattgcggcatgtcgcctgctatttggacaggcggtgatggaaatcgtggctgaaaataagccggtgactggtgaagccatttctgaaaaaattcatcaaatgtttaccggaatcaacccggaacccgtgatgacgctggctatcagcctgctgacaacccgcgccgactgaccgatcccggtcatcaagccaaagacctcaggccgccatgggcgtaatgccagtcagttaagcgacaggtgataacgcagtctggtgccgctcaggggctggcggtcctcgcgccgctgcgcggttccttcacttcattcgcctgcctgacggaccgccggggatggcacatcctgtgccgccccgcctttcgcccgcgtcctgcgggctctcctggcagactcattatgttcagcgctgcggattgcctgcccctgagcgaccccggcctgctcaggcccgcactgcggctcgctcgcccagaaaaaaagctggcacgtttgaccgtgacagcttttacaaatctaatcttaactgaccagtattacgccatgggcggccttttccttttctgcatgctggcccggcagggccgacgccgtaaaataataatccggttaataattcaggtctgtctctggcctgtcgtgctggcctcatattttaacaatatcgcaactatggaaccaatctgacactgcgctgactaatttgctgactataccgttacgttaccgttttcagaacgttaaccgggcgagtcttactttcattcagccagaacggcgtagcctttgcgcagaggatgtcagacatgcggtttttaattatttgtcgggataatattggcgacaccttactgaccacgccgctgatcagtgcgctggcgcaatcggggcagcatcaggtcgacgtgctgactaacaattacgctgcgccagtgttgcagcataatcccgatatccggcagctcttctattacaccaaactgcatcaccgtgaggcagggcagggacgactggcctgtgtattacagcgactgaagctgatgctgaccctgaaaaaacagcgttacgatgtggtgattctggcaaaaagccgctgggatcagcatggcctgaagtgggttaaaacagtgcgtcccgccagagtgattgccctgggccatccccatccgctgattaccgatctgctgccgccacccagccagtcgccgtgtcatattagtgaaaccctgtttagcctggggcggcctttcaatctcagcgccacagcgccaggcaaactgacgctgctaccggatgcggcaatcgcggccagcctgcgtgacacctgtgcgattgatcccgctgttccggtctatgcattgcagatcagcgcccgcaagccgagccagcagtgggaagccgcgcggtttgccgggctggctgaaaaaatcgcggcgcgtcatccctgccagataatgctgctctggtcacccggcagccgtgataatccgcgtcatccgggagatgatgaaaaagcgcgggaaattatggcgctctgcccgcatctgccgatcaaggcggtggcaaccaccagcctgccgcagttgattgcagcaatgtcgttgtgtcaggggctggtgagcagtgatggcggggcaatgcacattggtgcggcgctgggattgccggtcgtcgcgctgtttggcgacagcgatccggcgtgctggcatccgtggcaggttaactatcaggtgctgcaaccggcgtcacgtgaggtcaatgcgctgagcagcagcgaggtctatgacgccttcgcccataccattactcagtaagcctcttcaggccagcgtcccagtctggccgcttcacacagcatggcgaccgtcagtggacgataaggctgtgctgtgcccgcagtaaaccagtttgccactgcaaagcgccgtcggcgcggctccggaaaatagcgggcgtcatcatactgttctgaacagacgccgaaagtgataaaaaaatcactcatcagaatggcaaagtccacttcactcagcggtaactgctgcagatgaaatcccgcccgatccactttccggaaccagcccagtgcggttggctgattgtggtgctcaatcagcgcaatgatggattgagaaaggtcgttcattaccccaccagtttcgccacggcctgcccgacctcatcggccttgatcgttgccatcggatgctgtgaggcggttttatccgggcggtgaataatgatgtgccgatcgctgtcctggcagggaccggtatagcgcggattggcggtggagaacaggctgaccgttggcgtctgcgcggccacggcgatgtgcagtggaccggtgtccccggtaaccagcacatccagcgtgcgaatcaggctaatcaggccgctgagattcgttttacccgccatcggggtcacacgctgacggtagtgcaggggcaggctttcaataaattcctgctcaagaggctgctcagcggcggtgccggtaacgataatttccgtgtcaggccagcgttcaagcaaggctgtcgccagctggctgaaggaggccagcggccagcggcgaatatcttttgatgcccctaactgaaaaccgatacggcgatggtcagcctttgcagtcggactgttgttcagtgccggaaggtgcatccgggtctgctctgtctctgcgcccaggacttcaatcagtttcagcttacgcttgatggtatggtcgtcaaaatagcctgaatagtgatcgagatatttatttagcagaggcgactcgcggccgtaatgatcgcgcacaatcaccttactgccggtcagtaccgagctcataatatcgtaggggaaatgggcgtgtaatattactgacaggtcaggtttctggcggcgcagtttgaaaaaaagcggcaggaaattcgccagtttgttatcccagatatagatcttatcaaaccagttataacggctgacgagatccttatttttcttgctggaaaccagaataaatttgctggtgggaaagcgatttttcaggctccagatagccggcgtattcatcagaaagtcgcccagtgccgtggtggagtaaatcaccactgtttgcggggccaggtcgtgcaaggcctgtggttttgttctgctggaaaatcgagaatagagcgttaaaagtcggtctatcagataaatcttttttttcttcacgtctgaattctcttaaacgtatcaataatatttaacaaaaggtgttgtgagttattagagaatatttctgcgactaaagttcattattaaggtttattttttacggccgtagacgtttcgtttaaattgtttccacaattttaatgttgtttattctgggtatatatacagaattgtgtaaaagaagtaagagattattaaaaagagatgggatgattcttataaaaaggaaagtatggaaattattctgattccggctataactaatagcaggttaatgattagcggaattattctatgacttctatctattaaaaaacatgcgataaaacaaaccccggcacgtgagccggggcagggtattacgactgtggctgacccaccgggcctgaacccagcgtaccgcccggtgacgactgaccgcttggtgcatgagggcggccatcatctttaattgcgtcgctcttctgcgagcagcccgccagagaggttaaggtcgctgcaaccagcagcagggcaggaattgttttcataaggtcaccttgatgttgtcagaaagagacgaaaccagactaagcatagatacttaccgcactctggcctgaaaaggcttatctttcagatgtttctcagccggcggaaggcggcctggcaaaaaaaaacggaagccagtggctcccgtttctgttgacgttcagcgcgattacttgcggcccagcaggaagccgataaatacgccaacgcctgcagcaacggccagacctgcaacaggattggattgaacctgatccttgatacagtcagcagcatcgcgggcagcatagcttgcctggttggtgtaacggcgtgctgcgcctttagcctgatgctcagatgaaccggttgctgcaccccattgttcctgaactgcgccagcggcttcttttactttatcttcgatttttcctgacatttattgctccttggttttgagtgagaccctcaaagcgtagcaaagatagtgaattctgctcctccagcggaggaaaatgggctaaaaaatcatttctggctgttaatggcgctgcgtttgcgggtaagggatttactgtctagcctttggaaagagaggcgcactcaggcgctgccacagccatagccaaagctacagccggaggataagcaatgaaacgtgatgcactgaatgatgacgactatgacgaagtttgccgggtcattggcgatgcggtcattgtgctgtcagagcgcggccatgacacccgccgtggcgaaatctacgacctgcttaaacgtatacgtcagcagcgggcccacagtgaacgggatgagcagcggatgctggatcatgctatccggctgattaagcctgaggtttagcatagtgcggaaacgctgcgctactgcagcagcacgccctgaatcagactggcctcaacaatcgtaacctcattaattttcagcgcctgcatataaccttcaaccagtaagagattgctgacatcagtggcccggtagtcgcccgggagttcactgtcgcctttccagacctgctgctgcgacagctgacttaatgccgtcaggctgtaacgatggggtttgcccggtaactgattgcggattgaaaaaccatggacgccgccgatgccaatgacccgacggctcgccagatcctgtttaatctgcggactgacctcattagcggcataaaattgcacaaagcgcagcaccgactgccgccaggagccaatcggattaggggatttggcctccgggctgttcttcagcaccgtcagaataaagtttttcagcgtcaccgaggccagtttgccctgatagatatctgcaaccggctgacccgcctgctgtcgccaggcggtcatctgcatcgatcccccaccaatatcccagaccagcagttgctcatcacggatcgccggatcgttaagcgcggctttagcagagaggaaaccgagtttcgcttcctgctgctgcgagatgatgctgatttgcgcaccggtctggcgctgcaactgatcgatgaccgcctgtccgttgctggcgttgcggaacaccgcagtggcaacgccgctgatgcgctgtggatgaaagcgccgtgcctgcgttaaaagctgctgcagggcggcggcaccttcatgagtcatcgccgggctgagctgattatctgttgaatgcgctaaggcctcgttccaggccacggcgcgctgatcctgatacagcatcttttcgatgcgcagctggcagacattgacacgggctaccgcaattttggtggtgccggaaccgatatccagaccggcgcgaatttgctggcagcgatcggcctggacagcagcggtaaaaaacagtgagcagaaacagcgtgacagcagacagcgcagcagaacgcatagcgactccgggggcaatgaagatcagagtgaacgggcggcgacgcaggccggatagacgctcaccaggaagtgacgcagatgatcaaaacaccattcggcgtcatccgcctgtgggcaatagaactgaatagtgatcttttcataatcgcgctgacgctggcgcaacggcgaccagctccagtcgagtaccgaacgggcataattgaccagcgtctccgcgggcatctgatgttgctgctcctgcccggtcaggtagcgataaaagttcgcttccagctgcagcgcctcctcaaagccgtgttgcggcaggtcgggacgaaaagccacatcgataaagccacagaccgcatctgcctgctgctgccagtcgcaggccagggtcataaacagcccctcctgcagattgatctcctcgaccagccgccgcagattcactgaatggttcagcaccgcgatctcctcaaggcgacctgtttccagcgtcagatcaaagccacagggattcacggagccatccgcattgcgggtggcggggaaggggaagtcgatataaccgttgttatccagacgcttttccatcggggagacctgctgcttgacgtttcctgacaataaaccatctggcagcaggattcatcccttatggacaggtccaggtgatttgggtgtcctggtaagggttgatcaggcggaactgcttatctgacaggcgctgcgcgtaatagccctcaggcgtgacggcggagggaacatatttaaagcgatccagcgactgcagcgggccactcttaacgctgaccttatcccgggtcacggtgaagctattaaccagatcaaaaatcacgccctgggtatgccccatcgactgaccataaattgtcgagacctcacccggacattccacccctttcgggccagatgaacatccagtcaccatcgcgatgaggataaaaatgctgagacgcatcatgattttctacctgcttcaatccctgggagtttcgtggcgcagagtctatcctgctgcgtcactgattacttaatcatagcagtttacgctgcgcttcctgtttgtgatttgtttaatcgttaagcaacaggaatgtaaaagggtgactttgcttatcaataaacgttattcttggctcctttgcgcaccacttaggcaaatccagggataaatgatgaacgaagaagaagcaagtctaatgattattcgccatgcgattgaccagttagaagccgataagaagcaacaggtgatcgcttgttcagcggatatacgtgcagcaatgcaggcttacgatagcgagaatgccgggctggcactgatgttagtggccgccgaggtagcagccgaataatcatatccggtcagtgtggcagcctgttacgctggccggattacttcattttttctcaactttcagattacttcgcacgccgattccatctttcaatggtcttgctgcgggttgccccgcgtcccttctccgtcctgtgatgtgttaagctaaaaaacctcaataaaatcagcggagaaacagcatgaaggcagcattaattgccctgggcctgctggcctgtcacatcgcacccacctggagcgagacggaatttcagcttaactgtcccggccggacaaccatgaccgtttcgcgtgccgaatatgggttaaccacgttaatgtggccgccggggcatttccagattgccgccggtcagcagcgtacccgtttagaggcgggtgataaggtggcgattacccgctttcgcaatggcgatcagctgattgtgaaccagcgcaaccaggcgaccttttttgtctaccgcgacagcgataaactgctgccctgcagccgcagtgaaaaacgcgatgttgatgcgttgagcctggagcgctacgacgatcgtcagcactccgacacttaacccacggagccactatgcaacccgagattaccgataaggtcacaacgcaggatctggatgaagtcaggctgggtctgactgcgttcaacagcaaatatattaatattgatgagatcagatcgatcggcgtgtttattcgtgatgaccagggccgaaagctggccggactgaccggatcaaccgccggaaactggctgcggattgatatgctgtgggtgagtgaggcgctacgcgggcagggggcgggcagcaagctgatgcaggcggcagagcaggaggcgcgggatcgcggctgccgctttgcccaggtggataccgccagttttcaggcgcgaccgttttatgaaaagctcggctatacgctgcgcttcagcctggataactatccacggcatcatcagcgccactatctgacgaaagccctgtaatcagaacaacggttgctgacgcaaatccagcggatgctgttctgcttcatcaatcgcggccagccagctctgcagcgtgacttttttccaggagagatgcccgcgcgtggtactcatcagcaccacgtcgggacgcagggagcggtaaaactccagcgtctggctcagctcagccggattactgtccggcaccagcaccgtgatccagcggtcatgcgaacgcgtcacggtatcgccaacaaacagataggtcagccccagcggcgaggtgtagagatagctgcaactgcccggtgtgtgtcctggcgttggcagcagatggaaatccccgaagtgcgtctcctgctgcgaaaaggtgtcatcaggctcagcaaaacggctgatggggcccagcgatcggctatggcagtaaagtgcgctgctgaagcgctgctggatcagcgccgcaccgggcgcggattcatgccagtgggtgaggtagtggcggatcacgccgccggtatcggccatgacttcatgatcgagcggattttctacgcggccaatcaacagattgccgcgcgggtgacgcagcataaagccatgcatcatcaggtcattaacggcatcttccaccggaaattccggggttgagatccacaaatcgtcatacaacggcttcaatgtcgatctcctgaaacaaacgctattcccgcaggacgggatgcccggtcgcctgcaaacgggcgtggccctggctgaccgctaatcgtgagctggcacccaaaggcagtgttacggtgtcagcggcatgaccaaaatctaatccacaaatcagcggcagaccggtggtgtcacgcagtcgctgccagacggtgctgaagtcaaacccgttgtcatattccgtcagggctgtactggtgaagctgccggtaacgatcgcccgctgtcgcgccagaatgccgctctgctgcagctgaatcagcatgcgttcaatgcggaacggatgctcattcacatcctcaatcaccagaatgccgttctcaaactgcggcatccacggcgtgccaatcagtgagcagatcatcgccagattcccgccccacagtgtaccctgccattcaccctcgtcaggcgtttcgctttgccatgtcacctctactgtaggtgaagtcagtgcctgccagaagtggtgaagggtaaattcagataaggtcgcggcgccgaagttaccggccagcatcggtgcgctgaaggtaatcaggccgacctgcgccagcagtgccagctgaatcgcggtgaagtcgctgtggccgcacagcgccagcggctgattcagcagacggcgttgcaggccgatgtaatcgatggactccagtaaccggctggcaccataaccgccacgcaccgccagcaccacatcgggcagcgtgctgagactggcaagctggttgatatccgccaggcgctccgcgtccgtaccggcgaagcgctgaaaacggcgggtgatcacctgctcgttctctacctgatggccggccgcacgaagtcgtgcaatgccctgcagcgccgcaggctgattgtgacagtaaccggagggggagataagacgaactgaacgtgaaatcatcatactttcctgctgttagcgcctgactgacggcgatgatggcgaaaagcgccgctgaagtcacggtacgcgccgcattttcatgcatttaggataaacggtaattttgctctcaggctgcctgggtatgatagcattcgccacaacagctacgagatgaaaaattgctgaaaatccgacaccttatactctcagcgttactcctgaccggctgtgccagcgagccaccgcaccatgccgttaagcagcgcaacacgccattaactcaggcaccgccgtccagcgtcaatggcacctgggcgatgtttaccgaagatgccgccagtcattatggcgttgatgagaagttgatcagcgccattatcagtgtcgagtcgggtggaaatccgggcgtggtgagccgttcaaatgcggtggggctgatgcagattaaagcttcgaccgccgggcgcgaagtttatcgcacgctgggccgtcgtggacagccatcgaatgccgagttgcgcgatccggccaaaaatattgatatcggcaccgcctatatccgcattctgcagaactccgcgctgtcgggcatccgcgatccgctgaccctgcgctatgccaccatcgtctcttatgccaacggcgcaggggcgttactgcggactttctccagcgatcgcgatcgggccattgcgatgatcaatgcgatgtcaccggatgagttctatcagcatgtgcagaacaagcatccggcggcgcaggccccgcgctatctgtggaaagtcaccacggcttaccgcactatctgaccggttgtgatgaatcctgcggcgtgagcagcagccgcgccgtgggatagtcgatgatcagcaccttgatgtagccgcccagcagcgcaccgcgaatcgcctgcgctttctctcttccgcctgccagcccgaccacctgtggacactgttttacctgcgccagctccataccaatcaccggatcttcttctgctttcagcaccggctgtccgcaggcgtcgaaatagtgcagacagatatcgcctaccgcgccgcgcgccgccagcgtttgcagcatcctgccatcgtagtagttgcccgaattacgtaacagcgccgacggctccagatcgccaatgccgacaatcgccaggtcgacctgctcaaatttactcagcacctcggcgacctctgcgttggcagagagccgctggcgatcgctgaccgaatgctcaatcgactgggacggcagcagccaggcggggcagtttcagcagcgccgccagattttgcgtcagaatcgtggcctgcacattgccgttagccccgacgccacccagcagctggatcacccctttgcaggcgctgttgagcggatgcagcgcatccaccatcgcccggatcgtgccgctccatgacgaaataccaatcagctcatcgtttcgcagtcgggtctccagatagtgagcggccgccgatccaatcgcctgcttaatctgcagcgacgacgcctggtccggcacatccaccacaatcgcctgcggcaggttataggtctgctcaatggccttttccagctcagggtagacgttggctggtggcaccacgctgatcttgaccacaccttctttcacgctgcgattaagaatgcgtgagacaaacgactgcgataaggtcagcgactgtgcaatctctgactgcttcaacccttcgacatagtaaagggtggcaatctttaccatcagtcgctgttcatcctgttttgccatcggtttttccctctctgattctgcccggtattgttaaccaggatgatcaaaatcacaacgcaggctaatttgtgatcgttttcgctttttgacgatcgcgcattggacggcacgtcagcgcgggcgcatagtcattatgcatataaaatcgcgtgtgaatatatattcaagcggagaaaaataatgactcgtcctctgatcaaactgaccctgctcgcatcgatgctcgccttttcagcgaccgcgctggcggcagagcaaggcctgctggcgattatcaccccatcccatgacaacccgttctttaaagccgaggcggaaggggccttagcgaaagccaaagagctgggttacgccacgctggtggcgtcgcacgatgatgacgtaaacaagcaaaaccagctgattgagaccgcgattgcgcgcaaagccaaagcgatcattcttgataacgctggtgccgacgccaccgtcgggccggtgcagaaagccaaagatgccgggatcccgaccttcctgattgaccgggagatcaacaaaaccggcatcgcggtagcgcagatcgtctctaacaactatcagggggcgcagctgggcgcggagaaatttgcgaaattgctgggcggcaaaggggactatgttgaactgctgggcaaagagtctgacaccaacgcgggcgtgcggtcgcagggctatcacgatgtgctggatgactacagcgacatgaaaatggtggctcagcagagcgccaactggagccagaccgaagccttcagccgcatggaaaccctgctgcagaaacaccccaacatcgtgggcgtcatctccggtaacgacaccatggcgctgggtgccgaagccgcgctgaaagccgccgggaaaacatcggtgatcgtggtgggctttgatggcagcgactacacccgcgattcgatcctcaacaaaggcaatattaaagcgacggtgctgcagccgggctgggatcaggcgcagatggcggtcacgcaggcggattactacctgaagaaacggcaaagcgcagaaacaggagaagcagctgatggactgcgtgctgattgacgacagcaacgccgctaagctgaaaaacttcaacctggcgaaataaccatgaaacggatgctggcggtattgaccggtatggcgctactcagcgcctgcaccgtggtggatctggatgcggacggtaagccgatcctgccgaaggatccgcacgcgaaacccagctataccacccagacaccgcagcagattgcggaagagacctggcagccgcgcgtgatgaccaccgcgaacagccatgcgctgagctgggccgacatggaggcgaaaagtcagacggtcaaacccggcgggcgcgaaagcgtcttcgtgcgagccggggggacagccagcgcctttgatgagagtaacccgcgtgaacgcacgctgacgctgatgattaacggcaagccggtggcggtcagtgtcgggccggtgctgcgcagtaacgctatccgggatgccgccggattccgtttcgaagagtttaccaatcaggtgcagtacgcccaactgacccgggcgctgaaccgtcacgcggtgaagcaactgccaccgctggatgccagctgggtcaaccagccggtgcaggcgctgctggccgtaaccatcgggcagaacagcgttgaagatgtggtggcggttgagctgaagcgggggacgccctgatggacgatgagatcattctgcgggccgaacagatatcgatgctgtttcccggcacgctggcgctggatcgcgtcgactatcgggtctggcgcggcaaagttaacgtcatcatcggtgagaatggggcgggaaaatcgaccctgatgaaaattctggccggggtacagcagcccacggccggttcgctgttcctgaatggcgagccgctgacgctgagcagcacccgcgacgccgcccggcacggcatcggcatggtgcaccaggagctgaatctgtttgagaacctgacggtggctgaaaacctgtttctgggccgggagatccagcgcggcctggccccgatcaacgaggcagagcaggctcgccgcaccgccgcgctgatggcgcgcctcgatcagccgatttcaccccatgagcgggtcggtaatctcaaagtgggtcagcagcagctggtcgagattgccaaagcgctggcggaagatgcggacatcctgatcctcgacgagccgacctcggcgctgagcaaaaccgaagtggagatcctgttccgggtgatccgcgacctgacgcagcagggcgttaccgtgatttatatctcccaccggctggaggagctgatggcgattggcgacgtgatcaccattctgcgcgacgggcgcttccaggcagaagcgccggtcagcagcatcgatgtgccgtggatcgtgcgtgagatgctgggcagtgaaccggtcaccaccttcctgccggaagcgcgtgagtttggcgcgccggtgctggaggcgcagcacattacctgcgtcagccccaatggcaataccctggtggatgacgtcagttttcaggtgcgggccggggaaattgtcgggatttacgggctgatgggcgcaggccgcaccgagctgtttgagtgtctgcttggcagtcagcgtcactatctgggcaagctgtggctcgacagcaaaccgctgccgacccgtctgcccaccgccgaccgtattcgcatgggcatgagtctggtgccggaagatcgcaaacgtgccgggattttcccggtctcatcggtcgccagtaatctcaccatcgccagcctgtggcggcgtctgtcacatcgctttgccattgcccaccaggcggagcagcaggcggtgagccagacggtgggcaacctggcgatcaaaatctcctcgccggacgtggccattagcgcgctgagtggtggcaaccagcagaaagtggtgattggccgcgcgctgctgaccaatccgcgtctgctgctgctggatgagccgagtcgcggcattgatgtcggtgcaaaagcagaggtgtttcgcatgatggtggcgctatcgcagcagggcattgcagtactgttctccacctcggacctgaaagagattatggcggtagccgatcgcatcctggtgatgtcgggcggcaaacttacggctgatcttccccgcgaccaggcggaagaggcagcgctggtgaaagcaagtgcgcaggggttctgagcatgaaaagcaatgacagcgtcgcgctgaccacacttccggctaaggcgttcagttcacgtgaaagcattctgctgctgcttctgaagctgcgcacttttattgcgctgattctgatcgtcggcttcttcgccatcaccgtgccggactttctcgccaccggcagcctggtgatcatggtgaaacatatcgccatcaacgcctttctggcgctgggcattacctttgtcattatcaccgcgggaattgacctgtcgattggggcaacgctgggactgtgcggcatgatcgccggctggctgattaccaaaggcattgtgctgccgatgtttggcatcgctatttttcccagcgtctgggtgattgtgccggtggtgctgctgatcggcgcgctgattggcgcgggcaacggctggatcattacccgctacaacgtggccccctttatctgcaccctcggcaccatgtacatcctgcgcggcgcggcgatgcttacctccggcggcgagacctttcccggtctgcaggggaatccgctgctgggcaacaccggtttcgatcggatcggtgccggaacctttctcgggctgccctacgccatctggatgatggtggtgctggcgctggtgatcgcctacatcgcccgtcgcctgccgtttggccgtcaggtctatgccatcggagacaatgaacgtgccgctgaaactgtcgggtgtgaaaacccggcaggtaaaaattctggtctacacgctgtcgggattctgcgcggcgattgctggcatcgtggtctcatcgcaactggtcgccagccatccggctaacggcaccgcgtttgagatgaatgctattgccgccgtggtgctgggtggcacgtcgctggcgggtggacgcggcaccatcctcggcacgctgattggtgccttcgtcatcggctttctggcggatggcctgatcatgatgggtgtcagtgaattctggcagatggtgatcaaaggcatcgtgattatcatcgcggtgatcatcgaccagacccagagccggatgcagcagaaggcggccgtggtggctcagaaagcgttaatcgaggaggggacaccggcaaaaccctgacggggaagtgcgtgaaaccagacaggaggtgccgctgagtgattccttgcagcggacggcctgcccggtttaatgaacagagtagcgaacaaagggcggttcagtttattagccctctttttcaggcacaaaattttttaaccgacatgaatatatattcataaccgatttaaaattcagaggtagtgtatgaatcctttcaatcttccggtcgatgaccttgagcgccgggcgcgggcaatccgccgccgcatcatccagcttaacgcgggcagcccggcaggcggtcataccggcgctgacctgtcacaggtagagatcctcaccgcgctctacttccgcattctgaactgcgcaccggatcgtacagacgacgatcagcgtgacatctatatccagtccaaagggcatgcggtggggggctattactgcgtgctggcggaagcgggctacttcccgaccgactggctggcaacctatcagcatgccgactcgcatctgcccggccatccggtacggcagaaaacgccgggcgttgagctgaacaccggcgcgctgggtcacggcctgccggtggcggtgggcatcgctatcgcggcgaaaaaagataacagcccgcgccgcatctttgtggtgaccggcgatggtgaactggctgaaggcagcaactgggaggcggcgctggtggcggcgcattacggcctcgacaacctgatcatcatcaatgacaaaaacaagctgcaactggcgggcgcgacccgcgacatcatgaacaccgatccgctgccggaaaaatggcgcgccttcgggctggaggtcaccgaatgcaacggcaatgagatggcggcggtggtcgacaccattgaaaacctgccgaagaacggcaaaccgcaggtgattgtggcgcataccgagaagggatttggcgtctcatttatccagagcaaggcggaatggcatcaccgggtgccgaaaggcgaagagatcgcactggcactggaggaaactgaaagatgagtaatgcacaacatttagcaagcgtcatggtcacggcttttatcgacgcggtgaatcgcggtgtggatctggtgccggtggtagccgactccacgtcgacggccaaaatcgccccctttatcaaggcgtttcccgaccggctgattaacgtcggcatcgctgagcagacgctggtgggcacagcggccggtctggcgctgggcggcaaggtcgcggtgacctgtaacgctgcgccgtttctggtgtcacgcgccaatgagcaggtaaaagtcgatgtctgctacaacaacaccaacgtcaaactgttcgggctgaatgccgggaccagctatggcccgttagccagtacccatcacagcattgatgacattgcggtgatgcgcggtttcggcaacatcgagatctatgcgccttcctgcccgctggagtgccgtcagatcatcgattacgcccttgagcatgtcgggccggtctatatccgtctggatggcaaagatctgccgcagctgcatgaggaaagctaccagttcaggccgggcgcgatcgacctgctgcgtgaaggcagcgacatcgcactggtggcgatgggctcaacggttcacgaggtggttcacgctgctgagcaactggctgagcagggcatttcagccggtgtgatcgcggttccatcgattcgaccttgtgatacccaacagctgcgcaacctgttaaatcactacccagcggtgattaccgtagaggagcataacgttaatggcggtgtcggcagcctggtggccgaagtgctggcggaaggcggctgcggcatcccgctgttgcggctcggcattgcagatggggaatatgcgattgccggcgatcgcgcctctacccgcgcccatcatggcattgatgccagtagcgtggtgaacagtgcagcgcgcatctgcgcaggagcataaacatggtgggacccctgattctggcgatcgacgaaggcactaccaatgctaaagcgattgcggttgatcgcgatggccgtgtggtggcacgcggcagccagagcttaaccctgcaacacccgcagccgggactggctgagcaggaccctgtggcgatctggcaggcggtaaaagaggccattacccattgcctggcagcctgtggtggcgcgcctgtcgcggcagtggcgatcagtaatcagcgcgagtcggtactgatctggcagcggcgtgacggcaagccgctgacgccgctggtgagctggcaggatcgacgatccgagtcactctgtcgcgacctgcatcaggcgggcaaagcacctcgcatcaccggtttgaccggcctggccgttgacccgatgtttccggccgccaagctgaccgggatgctggccgccattcctgacggcgcggcgcgggcggcggcgggtgagctctgtatcggcacggtcgacagctggctcagctggcagctcagcgccggcgaggtatttattaccgatcatgctaacgcctcccgtactcaactctacagcctgcatcttaatgactgggacgacgagctgctgacgctgtttcagctgccgcgcgccgcgctgccgcgcatcaccgcctcagccagtgaacagggcgtggtcgcggtgagtgatattcccggcttagcgccaggcacgccgattctggcgcgcatcggcgactctcatgccgccttacaggcgcagcggcgcggcgagtctgaagtggtgaaagccacctacggcaccggatcttccctgatgatgtccatggcaacgccgctgctgacggaaaatggcctcagcaccaccgtggcctggcacgacggcacgctgcgttatgcctttgaaggcaacattacccacaccggttccggtgccgcctggctgggcagaatgctcggcgtgcaggagccgcgcgagctcaccgcgatggcgcagcgctgcgacgataatcagggcatctattttgtcccggcgctctctggcctgggcgcgccctggtgggatctgcaggcgcgcggcatggtgtgcggactgacggatgccgccacacccgccgtgctggcgcgggtggcgctggagtcgatcgtctggcaaatcgccgacgtcttttttgccatggagcaggccagcggccagcagcttccggcgctcagtgtggatggcagcgccaccgaaaatagctggctgatgcagttacaggcggatgtgttacagcggccgttgcagcgggtgcctaccgccgaggtctccgcgctgggcgcggcactgctggcaggcaaagtgctgggatggtggcagcagggcagtgatatgcaggcgctgcagggcggcagcgtcatcatgccgcgtgaagagcacgcgcagcgtatgcaggaaaactataaaggctggattgacgccgttgcacgctgtcgttatcagccacattaatccttatccggagcagagccatgtcaacacttcctcagcagttaaccttcggcgtcattattggcaaccggggtttttttcccagctatctggtgggcgaggcgcgccagcaggcggtcgcgctgtttgaaaagatgaacattaatacggtgatgctggatgagacccagaccaacctgggcggcgtcgagacgcgtcaggaggcgaaaacctgcgccgcgctgtttcgtcagcaccgcgaagcgattcacggcattgtggtgctgctgcctaactttggtgatgaaaaagccatcgcggaagcgctgcgtctcgccgggctgaacgtgccggtgctggtgcaggccgaagaggacaatctggataaaatgggactggcgacccgccgcgacagcttctgcggcaaaatttcgctctgcaacaacctgcggcaatatggcatcccgtttacgctgacccgccagcacgtctgcgccctgagcggcgacgtgtttatgcaggatctgcagcggttcagccagctctgtcgggtggtgaatgctatgcgtcgggtacgcgtcggggcaattggtgcccggcccgccggattcaacaccgtgcgctacagcgaaaagctgctggagaagatgggcatcgcggtggagaccctggatttatcggagatctttacccgcaccaaccggctgcgcgatgacgatatccgcgtggcagagaagcgtgaaatcctggaggccaacgccgatgcgcggggtattccgggtgaaaaactggtgaccatggccaaactgtttgtggtgatcagcgagtggatcagcgacaacgatatcgataccaccgccatccagtgctggacgtcgttgcaggagaaacctgggcattaacgtctgctcaatcatgagcgtgatgtcgggccagctgatgcccagcgcctgcgaagtggatgtgatgggggcgctgtcgatgtatgcgctcgccagttgctcgctgaaccccgcctcgctggcagactggaacaacaactttggcgacgagcgggacaaatgtgtgctgtttcactgtggtaatttcgccagcgccagcctggagtcagcgaccatgggcacggcggatatcatcggcaccaccgtgggcaaagagaacacctgtggcgcagtgcatggccgcatgaagcagggcgatctgacctatttccgcctctctaccgacgacttcagcggcgaaatcaaagcctatgtgggagagggaatgtcggtcaccgatccgctggacacggtaggttgccgtgcggtgatccaggtgccgcagctggagacactgctggcgtggatctgccgtaacggctttgagcatcatgtggcaatgaaccactctgccacggctggtgtgctgcaggaagcgttcagtgagtatctcggcgtgagctgctaccggcatcagtaagcggtaaggcggaacggctgaatgcaggggatgaagcagccggtgcggtcacgattccgcccgcaccggcttgtatgcccgccacttctgaaaaagaaaggcgggcactgatttagcgcgccattctgcgcacctcgtcatcgtcattctgcaccgcaaccagatccaccggtggcagattgccgccgctgaactccacctgacgaatcgggaaggcgaagcggatatttcgctcttccagtgctgccatcagctgcaggttaatctcctgctgaatatccatgtacttgttgtaatccgcatccagcacaaaatagaccacttcgaaggtcagttttgaatcctcaaaggccaggaagtgggcacggtcaaaacgggtggtctcaacgccctggataatctctttcaccagcgggctgatctcccggacctgctctgacggcgtggcgtagctgataccaaacttaaagacgatgcggcgctgctgcatgcgcttatagttgtggatcgtctgctgcaacagaatggtatttgagcagacaatctgctcgccactcaggctgcgcagtcgggtggttttcaggccgatgtgctcaatggaaccggcaatgtcaccaaagacaataaaatcgccatgctcaaacggcttatcaaagcctattgccagcgaagcaaacacatcgctcagtacggtctgaatcgccagcgcaatcgcaatacctccgactcccaggctggcgaccagtgcggtaatgttgatgcccatgttcgacagaatggccaggaacatcatgatccagaccaccacccgcagcagaatccccaggatcaccgtagtgaccgggttgcgcacgtgcagcgggtcacgcagcagacttttcagccatagccggatgccacagtcgagccacagagcgagctgcacaatcagcgccaggaaccagccgtgcgcgatggttacactccacgacgcgggcagatcgacaaacttcagggcaatcagcagcgaaaagatcagcagcagggtctggctggtactgcgcaatatctccaccagaatcgcagtggcgcgaacatgacgatgttcgctgtaaagggcaatccggttggagataaagcgaatcagggtacgtaatacccagtaaatcaccagcgtggataccaccacgatggcgctgtttaaccagagttcctgattaaaaaagagggagtgaaaacgacgtgaagagagccagttttccattggggagggtctccttgctgggttccggtttaaaagaaaacaagcaagaagcatagcctggatgcggcccacctgtgtggcgcatccgtaaagcggttactggaatcgggtcgatttatcgcgcgccaggcgctcaagggcaaaaataatctgctgaagctgccgctcctgcgccgggttcagcgtggcaaaacgaaagctcagtcgcggtgtgatgcgggtttcatttttgccggtcaccacgctgcgctcgccaatgctcagcagctttaccggcacgtcaaaatggccatactcgcccagctcgacccggaacgggttgaagctgtcaccgtcctgcaacccgtccggcagcgcttcatcgaccagcacgccgataccgcccagcgacagatcctgcagacgcaggcgcgttttcctgccatcgggccacacggtatgacaccagaactgcggctccagcggagcgcagacccggaaaaactcacgtcgctggatctgccagagcaggtctggcagcggcgcgctgaaagcgggtaacccttcaaactccacgatttccagcgaggcgaggctgaattccaccttagcgccgtaggtttccgcggtgatactgagatcgtcgctggtcagggcataatcgttatccagattattactgccgaggtcaaacagcaggcgatcttcatcggcagccagcatccggctgataaactgcccacgcggaaagcgcaccagtaatggcgtctgcaatcgcagcagatctttcataacgccaagaaccgccagcgtgccacgttttagatattgttcctggtcggcttctttcacgtcctgctccacaaggggggttactttattgatgcggtttttttgcctcgtctcggttatcggcgcggctaaaaaaagctttagcatgctattcatcaataataactgtgagcaggcaggcattttttgaaaagctggttatacttatcgcggtaaaccgcttgattaatcaggcgttcacgatttaatcaaaaaaggaaggagcaacagatgggtattatttcctgggtcgtctttggcttaatcgcaggtattctggctaagtggattatgccgggtaaagacggtggcggtttcattctgactatcgtttctgggtattatcggtgcagtagtgggtggctggatcagtacgctgtttggcttcggccgcgtcgatgggtttaacttcggaagttttgtggtcgctgttatcggtgccatcgtggtgctgtttatctaccgcaaagtacgcagttgaccgtaaaggtttaaacgaaaaaggggacgaagcgattcgtcccctttttttatctcttattttgcaatcagaagtcgtaaccgactgtcgccattacactgcgctctgcgccccagtagcaatagcccgtgccgtaacagcccgctacataggtacgatcggtcaggttattggcattgacctgcacccatgcacctttcaggctgttgttccagacgccgagatcggcccgcactgacgcatcaaacagcgtaacagacggcacacgcgtggtgttttcattgtccgcccactgtttgccgatgtaacgcacgcccgcacccgcactcagaccgtaatcaaactgatagtgaccccagagtgcagccatgctgttgggtgtgacatatggcgtatgtccgtcgttgccatctaccgactctttaaagcgcagatgattcagcgtatagctcgccacggtgctcagacgcggggttaactgattatgcgcttccagctcgatgccctgtgaatgcactttgcccgatggcgtataagtcgccgtcagcacgtcgcggttcgccacatctttctgcgtcaggtcatagaccgccacgctatagagatcgcgggtgccgaccggctgatatttcaccccagcttcatactgctcggcggtagttggcttcagcaggttgttgttgggatcggtgagcgcggtcggggtaatcgcctggctccagctgacgtaaggcgagataccgttgtcgaaggcatagagcagtgctgcgcggccgctgatgtgatcatcctgacggcggtcactgccgctgttattggcgacaatgcggtcataacgaccggagagatccagatgccagcgatccagcttcatctcatcctgcagatagaggccggtctggtagtagcgacgggttttatcggcccaggtgtaatcaggcatgtcgccaacctgttcaccagtccgtgcattaagctggttggccgagccgccagcggcagtgatctcatttttatagcgatgatactcagcacccagggtgacgcggtgctccagctcgccggtatcgaactccgcctgtaagcggttatcggtggaccaggccgagagcgacgagcgctcgccagagtaatatcggttcagcagatcgggattcacgctgtcccagccaatctgatagacctgatcgagatcgacattcgagtggctgtagctgccggtcgaggagaatgaccagacgtcgttaaagcgatgggcgaaatcgaagctgtagatctgctcgcgacgcttgaactgatcgagatcgctgttgccctcataaaagccgttgctcagcttgtagccgttgtgttcggtgagactgccgtcacccggtaccgaaccgtgatagccgcccgacggatccttctgcagataggctttcaggatcagatgcgtatcttcatccggctgccacatcagctgcggcatcagcgcatatttctcttcgcgggtgtgatcgtactgggtatcgctgttgcgggttacgccggtcaggcgaaacgcccactgatcgttgatggcattggtgtagtcaaacatcgtgccggtggtggcgttgctgcccgcctgcaactggatgtgaccctcttcgctgaactgaggacgcttggtcaccatgttcaccagtccgcccggcacggtctgaccatagagcgcagaagaggggcctttgatcacgtcgatgcgctcaaggaaggcgttatccacctgcaggccgttgaaactgccgccgtcgctcatcagccgcatgccgtcgaggaaggtgttatcgacatcgccgccatggaagccacgcagggcaatggtgtcgtaacgggtcgcggcaccgccgaagttggtgaagacgccggaactatagcccagcgcctggttcagggtcagcgcgccctgatcctgcatctgctggcgggtaaccacggaaatcgattgcggcgtggtgatgagcggacgatcgcttttggttgcgccctggctggtcgtcgccagatagccctgggtcggcgaggtcgaatcttcctgcggttgcgcggttaccaccatatcggcagcataactcagagcaggcgcggtcagcgccagggtgcataggggaacataacctttcagcgacaatgacagtttcatcaaaattcctttcttggcaaaggttcaggcaggtgaataaaagctttgataggcaatctcattatcataatgagaattattaccttttgtaaattggctgcaattttgcctgttgatgaaagaaggtcaagtaaaattcgcggaaatgaagtggggatacccccggcaaggccagaggtatccagagtggattaaggttgtgaggcagacgcctgcggaatatcgtgggcgctgttacaggttttatctttcgggcagtacttatccagcagtttcagcgtgacgccgttggtccagccgaagccatcctgcagcggatattcaccgccaccgccgccgccgagatttttgccatcaacgacatatttctccaccagcttatgctcacggtcataggtgttctgaacgttttgcaggaagcgtaatcccacctctttcgccagttttggctggttgtaatgctccagaccttccacagcaacccactgcagcggtgcccagccattgggtgcatcccactgctgaccgttgttcacggtggtggtcaccagaccaccaggtttcagcagctgtttttccactgcgctggcggtgctttcagcctgcttatcgctggcgacctgcagatagagcgggaacagcgcggcagcagtcagctgaggatggacctgctttttctgccagtcataatcggcgtaccagttctgtttgctgtcccacagatagcggttgatcgccgcctggcgcttctccgcgcgatcggcaaactgcttcgccagatcgctctgcttgttcatctgatagcctttcgacagggtctgctccagatggaacagcaggctgttgaggtcaaccggggccagctgcgtggtacgaattgtcgacaggttatgcgcatcggtaaaccagcgcgaactgaaatcccagcccgacgccgcaccggaacgcagctcccggtagagttcggctttattcctctgcggcgctttctgggcggtggcaatgtcatccatccaggattctgtacgtggcacgtcgcgcgcatcccagtagcggttgagcaggctgccgtccgccagcttaatcacacgcttgctggctgcgcccgccgcgactttatcgctgtctgccatccagtagtcatactctttctgcagctgcggcagataacgggtataggctttgccgttatcgtgcgtcgccagcagatcgaccatcaggctgaagaaacggcggctgtgaccggctcagatagtagctgcggttgccgttgggaatgtggccatagcggtcgagcagcgaggcgaagttatccaccatatcctgcactttatcccagtgtccgctctcggccagccccagcatggtgaagtagctgtcccagtaatagacttcacggaagcgcccgcctggcaccacatagggtttgggcaacggcagcagcgagtcatactgaccggcgctgctggtggtgcgcgtcagcaccggccacaggccatcaatgtggtcacgcaggttttgtccggctggtggcacatatttgtcaccggccgcgggcagggtaaagttggcatccacaaaacgcttaagatcgaaattgcgctgtttcttctgcatctgccagtcggcaagaattgaggcgggatcgaatttcggcaccgcatccgcaaaggtcttttgatcgggatagaacttcgcctgttgcacggcattaaacagcggtcctaaacgaacgtcaggcggctgcggctgattattcagcatgcgactgttgtcgtcggcctgggcagtgaaggcgggtacgctcagcagcaacgtgagcagaaagggcgcataacgctgacgccgtggagcggcgtttacctcaatttttgtcatcggtttttctccttgtccgaaacgcggccgcgcgtaacgcattgaccacaggaccaactttagaccttatctgaccacttcaccctgaagcgagccggaaatgtgaagccacgggaattatttttatggaaaaaaccgctttattacgctggttttttcttgctctcaccctacttttccctgacgctgaaagaaaaaaaggagagcaggatggagatcatctggtatcacccgtcgcagtctgcagcggcctggattaacggtttacaacagcggctgccccaggcgcgggtgcgtgcctggcagccaggcgataatggtccggctgattacgcgctggtccgttcgccccccacagaaatgctacagggacgcgccaccctgcgcggcgtctttgcgctgggggcaggcgtggacgagattctgaaacagctgcagcagaaccctgagatgctgcccgacagcgtgccactgtaccggctggaagataccggcatggcgcggcagatgcaggagtatgcggttcatagcgtactgagctggttccgtcgttttgacgactaccgtctccagcagcagcaacagtgctggcagccgctccccgcttacacgcgtgaaaactttactatcggcatcctgggggcgggcgtgctggggcagagtgtggcggaaagccttaaaccctggggattcccgttacgcgtctggagccgctcacccaaagaaattgatggcgtgaccagctttgccggtcgcgatgcattgcctgcctttctgcaggagacgcgggtggtgatcaacctgctgccgagcacgcacgagaccattaatcttatcgaccaccactttttacagcagctgccgcacggcgctttcttcctcaacatcgcgcgtggcgcgcaggtggtggaagaagatctgctggccgcgctcaatagcgggcagctgaaagcggcggcgctggatgtctttcaggttgaaccgctgccggaagcgcatccgctctggtcacatccgcgcgtcacgatcacgccccataatgcggcggtaaccttgatcgacgaagctatcgactacatcgcccgcgccatcacccaggaccaggcaggcgagccgccgcagggcagggtggatcgtcagcgcggctattaatgaaccggccccgtcaggggcaatcagcaggagaagaggatgtatccggtagatcttcatatgcacaccatcgccagcacccatgcttacagcacgctgcacgactacgtgactcaggcgaagcaaaccggcatgaaactgtttgccattaccgatcacggccccgacatggccgacgcgccgcactactggcacttcattaatatgcgcgtctggccgcgcgtgatcgatggcgtgggtattctgcgcggtatcgaagccaatattaaaaatcagcagggtgaaatcgactgtttccggcccgatgctcgatgcgctggatttgatcgtcgccggttttcacgagccggtttatgcgccgcgcgaccggaaacatcacacggatgcgatgatcgctgcgatggcgggcgggctggtccatatcatcagtcatccaggcaacccgaaattcccggtcgatatcccggctatcgccgaggcagccgcgcactacgatgtggcgctggagctgaacaactcctcctttacccattcgcgtccgggcagtgaaccgaactgccgggctatcgccgccgcggtgcgcgatgccggtggacgtctggcatttggctccgattcccatacggcgtttacgctgggtcacttcgatcactgcctgcgcatcgcccgcgaggtggattttcctgaggatcgggtgttaaatgtcacgccgcgtcgcctgctcgactttctggagctgcgcagcggcaaacatattgctgaactggctgacttttagcgccatgccaggtaagcaacacgctcaccatgatgaaaatccccgcttttatctgcggggatataatgactgaggcgagtattttaccgtaacgtgttctcttatcagcccggaaagggcgtgtggcaagacctgaagcttaaagctgagagagcacttaataactgaaaaatggtctcaatcgttcgggttagcaatgtcaacggggcggttcgtccgggcgggtaatggcgtaaactttaagttctactctgctctttattgatcgcgttagatcaaagcgtagaattaccacgcctggtaacgcgctttactaatttaatagttaaccatgctaatagcaaagctgaaattattattgctatgaataatgcattcgctgttgaagggaaaatttgaaatggatttacgatttcaccgagcttcatgtaagcatcttccgaaagggttctgaagatgatttccgggatcactataagataaaatagagtaaatacggtgtataaagccagccacttgatccttttcataagccattctctttgcatacctttcacttcagtatacaatcgttgcataaggaattctacacaaagggatgagtatgagcatgtcttatcttaagattaaacttcaggcagagcgaaccattgcgcttaactttgagaaggcacttgctgagttacatcaaacaatgcttgatacaggaagggggattgtgtctggcgctcaacgtgcaagcggctatggttcatgcttttttgatgactacaaggatgtttgtaatcaacttaagcaggaagatttgcgatacctgaagcaactcagaatgctgtttacccggcaggacgtggttttagagatggtagaaatatacttcagaaaaaaactgagccgtattggtgatacaggcatccagaaacatacagagactgttagctgaaaaagcgtctgattatgcttctggtaaattctctaaacttgctatagcacagttaatcgcgctcgttattacacaatcccgggatttcaaacagtcacatattaatgtaattaatgctacaagttcgtatgccgtaaccgcttttaaattttatggtaagtttgagattgccacaaaagcagcaagaaaattacgcttcgatgatgcggagtattacttcgacttatataatgctaatttagaaatgttctattatttgattgagccggaaatgtctaaaataatctatttgaaaaattcaggttccactagcgaagagcagattttaaatctactaaaaagattttaataaaatgaaggcgatccttcgctggctatatgcctgggtaagtcaatccttctttggacttataccaccagcggccggtctggtcggggccattttttttgtaagcgtttttcctacatatggtctgctgttcgcttttctatggatccttttaattatttatttttgtggaaaatattttcgctattactagtggaggtaagcccccgtatgaaaagtgctttttattttattctatttttttatgaaatttacgagtttgattagcctgttattgcatatcttcattccgcctggctaatagttcatcagaatcagaagttgctggatgatgtattctgaagttttctatgcaaaattaaccagttgctttaagattttttctgaagtatgaactcactttctggctgagatagccaggtgtaagggtggattactcagagtcccggtcatcgccgttgttaagaccgccgatgccggtggacggctggcatttggctccgattcccatacggcgtttacgctcggaaattttgaacattgcctgcgcatcgcccgcgaggtggattttcctgaggatcgggtgttaaatgtcacgccgcgtcgcctgctcgactttctggagcagcgcagcggcaaacatattgctgaactggctgacttttaatttacttgcctcaaggaaatctgactcatgaatgagttttccattctgtgccgcgtgatcggctcactgtttaatcgtcagccgcaggacccgctgctggtgccgctgtttacgctgctgcgtgaaggcaaactgcagtcgcagtggccgctggagcaggatgagctgctgacccgtctgcaacagaacagcgatccccaggcgctggccgccgattacaacgcgctgtttgttggcagcgattgcaacgtgccgccgtacgcctcacagtggccggaaggcaaaacggagccagaagtgcgtgcgtttttaacctcacgcggaatgccgctgagcgatgcgcctgctgatcattttggtgtgctgatgctggctgcgtcatggctggaagatcagtcagcggaagatgagagcgcggcgcagatggcgctgtttgaagagtatctgctgccgtggtgcggtgctttcctgggtaaagtggaagcgcacgcgaccacggccttttatcgtactcttgccatgctgagccgcgaagcgatccaggcgatgtacaacgaaactgctggatagcagcgaagagacgcctgacgcctgattcaccacgtcgccgggtgcgtacccggcgcacagtgctgaatcatctttctcaatgggttctggggggattctctggatacggcgtgctttttttcgggcacctgaaccctctcaatcggcttacaggattaactgcccgggtcggcagccatacagttttgcgagacgttcacgcgtctttttctgcggcttactttcaatacgctccagttgagagatcgcactttgcgtggtacccaactgctgagccacatcatgctggctaagcccccgccagatgcgccaggccgcctgaagactcacttcctgctcaatcataatccctgcaacgtcgtgcgggatcgtctcatcgtcgtgctcgtcagcctccacaggaatcgtctcccattcgccatcgctggccgagagcagcctttcatattccgccaccggcaagaccacaaactggggtttgcctgcttcatcatagatgtactgttttgacatagtttatccgggtaattgtgtgtcgcagcagaggtcgtgagtgcgtaagactatgccggtatccaaaaagctttagtaagtggcggatgttcttcttgctacctctgtaatttccagaatcaccggttcgcccccggttaacgtaaaaaggacccggtagttgccaacccgcagccggtagtgattatcgctgccctgcaattttttaatgtccagtgtgacgaccgggaaacagactaactcacccaccttctggtaaatgattttctggtaacgtttgtcgatcttcataaggtgcttcaatgcccgcctggaccagtctaccctgaccattctgcaccccgtttcaatgaacttcttccctgagccatgtgtaaataataagatagcaatctaataccatcaacattatttttctaattatctaatgtttcgcttcaccacgtcgccgggtgcgtacccggcgcacagccaggcatcgcacagagctgtggggtgccgggcagccaggcggccgctcgcagcctcactccaagcccccacggcgttaattcgtaacagggcaggttatccttaacctgcggcgcaatgccggagcctgtgcgctgatcggtgggatgctgctgcaacagccacgcggtgcgcgccagcgacagccggacctggctgccgtggccctcagtaatgcgtcgccgtaatccctccagcaccgccgccgccagcagatagccgctggcatgatccagcgcctgcaccggcagcgggaccggtttatcgctctgctgccactgcatgcctctttcagcaatgccgcatcccatctgcaccagactgtcaaaaccccggcgattgcgccacggaccctgccagccccaggcattcaggccggcatcaaccagaccgggtgagagtgactgaagggtctccgcgtcaaacccgagccgttccagcgcatccgcccgatagccatgcaccagcacgtctgcttcacgcagcaggtggataaactgctcgcgatcggcgtgctgagtcagatccagcaccgctcgtcgcttgccgcagctcatctcttcatccagcgtcggctcctgccagccgggcggatcgatgcgcagcacgctggctcccaagctggcaagaaaacgggtagcgaccggcccggcaataatccgcgtcagatccagtactttaatgcccagtaaaggacgggcttcggccagcggccacgccggcgccgctgcctgttgtgtggtctgccagctaaatagcggttcgcgctgcacggcctggccctgcggatgctgcttccaggcggcggcactgcgcatctctgcggcacagccacccgcatcaataacggcctgctccagtttcgctggcctgccactgttgcacctgctgcgccagtgctgcgcgatcggcgtgcgcgcccagcacccgctccatcgccagccggtgatgcacggcgttggtgtgcagacggatccagccatcccggctgcgatagtcaccggcaaacgcatcccacatcgcgggtgccgcgcgattcagcggatggaagctctgctgaaaccagcgtgacgccagccggacgttaacggtgacgggcggagagagttcagggcgggatgtggcgataagcgcagcagcagcctgcgttgccagaccgatactggtggccgccagttcactgaccgaaaaggcagaagagaaggtggcgcgatcaacgaaggcggggagaggccaggcggcgtcgcgacctcgcaatccctgctgcatctgctgccagagagaggcggcaagcggtgagtccatgttgtgcttcctgagagaggtgatttctcaagcatagcacgcgggattaacgccgccgcaggcgcgggaagcgggcatgcatccgcaggctacgcaggttgattacggcaatagcggtgccaaggatcaccagcgacgcaccgataatcttgaagctgttgaggctgtcgcccagcaccacaatccccatcagcacggataataccggcgtcagcagtgagtagggcatgatcaggttaacgttatatttcttcagcagcatataccacagtgtataggcgacaattgacgaggcgatagcgctgtaaagaatggcaaaccagccatgccagcccgcattttgcagggcgtagagctgatgtgattccatcaacagactggatgcgccgacgacaggaatggccagaaacgcaatccagccggtcatggtgagcggtttaatcggcggtgacttttttacaatcaggttgctgacagcccagccggtggcgctgcacaacaacagacaaagcacccaccacgacggaatcgtcgggctgccggacagcacgacaacgccgctcagcgagatcataatgcccatcagctgcaccagcttcagcttctctttcagcaccaccatcgccagcagcatggcaatgggtgtaccgagctgaaccacaatcgcgccggtaccggcatcggtatagcgcaggccgacaaacagcagcgaaaagtgcataaaaccgaacgtgaaagccagcagcaacagccagggtaactgctgacggttaatccggcaaaacggtaccagtacgatggcgacgaccacaaagcgcataaacgtcaggaaaagtggcggaagctccagcaggccccatttcaccgcaacgttgttgaaggcccagattgaaaccaccatcagaatcagaaaaaaatgccgcacagccacgataatatcctttcgatgttcttttgcttagcccgctaatgatggcacgaactgcggcattgcagccaatcgcagggagaaattttctgcgattgcggcgcagcctgatgagactttcgggcgcgttgctggcagactgatttgaaacgacttcttaaaggaactgattcggtatgacctacacgtccgccttaccccttgcgttaattcagcttgaagtcccacctgcaaacgttgtctcagagattggtgaacagccgcgctggttcatcgacgcgttaaacctgcaacccgatgaatacctgattgtacggccccatctgggcgaggcgctacccgctttcgaccagatttccggggcgatcctcagcggttcctgggcgatggtcaccgatcacgctgaatggagcgaacgcagcgccgtatggattcgcgcagcgatggatcactgcttgccgctgctgggggtctgctacggtcaccagctgatggcctatgcgctgggtggcgaggtggcggacaatcccaatggatgggaacgcgggctgttaccaatcaactgtatgccggaggcgcagcgcgatccgctactgaagaaattgccacaggacttcagcgtctggctgtcacatcgccagtcggtgatcagcgcgccacaacaggcgcaggtgctggccgcctctgcgcgcgatggctgtcagattgtccgttattcgccgcaggcgctatcggtgcagtttcatcctgaattttcacggcacatcatgaatgtttgtatgcccaaaggctgtacagaagatggggcaaacgagatggaggggaaagactgggcgcgtgagttgctggtggcgtttctggcaacaaacgcgccctgtaatggcgcaagctcagggtgcgtagtgacgcgtgcagcgatagacccaggcgggtggcacgtttttcagcacccgctggcgctcccaggtgaagtagcgcgacaggtctggctgagtcagcgaggtatactggaactgtacaaagacgccgttgggcccgagcgcgttatacaccgcacgcagaatcgcctcccgcaattcagtgggtaatgagagcagcggcaggccggagaagatcacgtcatattctccgctcaggtactccgctgaacaggtgcgcaccgtcatgcgcggatcgttcagcgcatttagcttatcggccagcgtgctgctgatctcaaaggcatccagcgtggcatcgggtgacatctgcgccagtatctgccgcgtcagtacaccgtcgcccgcgccgagttcggcaatacgtaacttttcaggccattccaccgacgcaatcatggtgcggcacagcgcctctgacgagggcgtaatgctgcccatcttgcgcgggttgcggataaactgatgcacgaaattggctttagcgcgcatcagggtaaaagctgaagccagcatgctcatctccagaatgaattcatcctcacgttgacccctttgtgccgcacaagtttctctctgaccagccttttgggtaaaagtcggaattatctaaagacgaagcgtaaacacccattccttcggggcggtcacagtttccggttaacagaactgacaggctcttgatgatgcttcatgttaataataagtttcatcattgttacatcagtcacctgtcaggagaatgatcatgcgttatgccgcccccggagaacagggttctctgattaccctacaaaagaattatggcaacttcattaatggtgaattcgtcgcgccggtgaacggcaactacttcaccaatacctccccggtgaacggctctgcggccggtgagtttccgcgctcagacgttgccgatgttgataacgctgtggctgctgctgcggcggcggcggaagcctggggcaagacctcgccgcaacaacgctcgctgctgttactgaaaatcgccgatcggctggaacagcatctggagacgatggcggtctatgaaacctgggataacggtaaaccggttcgcgaaaccctggcggccgatatgccgctggccgtcgatcacttccgttactttgccggttgtgtccgggcgcaggagggcagtgccgccgagattgatgagtttaccgccgcctatcatttccatgagccgctgggcgtggtagcgcagatcattccatggaactttccgctattaatggcggcgtggaaactggctccggcactgggcgcgggtaactgtgtggtgctgaaaccggctgagcagaccccgctgtcgatcaccgtttttgtcgatctgattaaagatctgctgccgccgggtgtgctgaacgtggtgcatgggttcggcaaagaggcgggtgaagcgctcgcctcccattccggcatcgccaaggtagccttcaccggctctaccgcaaccggcggtcatattctggagctggcagcaaaaagcctgatcccctcgaccgttgagctgggcggtaaatcacctaacatcttctttgaagacatcatgcaggcggaggagagctttatagagaaagccgccgaaggcgtggtgctgggtttcctgaatcagggcgaagtctgtacctgtccgtcgcgtgcgctggtacaggagtcgatctacgaaccttttatggcagccgtgatgaagcgggtaaaaaccatcaaacgtggcgatccgctggataccgaaaccatggtgggcgcgcaggcgtcgcagcagcagttcgataaaattctctcttatcttgaggttgcccgacaggagggcgctgaagtgctggtgggcggtggcgtagagaagctggatgactcacttaacagcggctactacattcagccgacactgctgaaaggcaacaacagcatgcgcgttttccaggaggagatctttggcccggtcattggcatcaccacctttaaagatgaggcagaagcaatcagtatcgccaacgactccatctatgggttaggtgctggcgtctggacccgcgatatcaaccgtgcttaccgtgtgggcagggcgattaaagccgggcgcgtctggaccaactgttatcacctctatccggcgcacgccgcctttggcggttataagaagtcgggtatcgggcgtgagacccacaaaatgatgctggatcactatcagcagactaaaaacctgctggtcagctacagtatcgagccgctgggcttcttctagtttctggcccgcaacctgccaggataaccctgcactcttccctcagaaccacgctacggcgtggttttttttgctccacgtagccgggcgcgctgagaagcatcagaagcatggcgatggctgcaatgccgataaagaacaattaatcagtcctttcttaaagcgacgccgggccgttttgcgcttcgcttatctcgcttcacgaccaccttatcctcagccctttatgaaccgtcccataatgaatcaacttgctgatttgtaaccattatctcacttttttttacgctaaaaactgccacgtattacggtcacctcgccgttaaccttcattacggcttggtgaaacagcgccattttatacatgagtttttttaatgctgactacaggggtgtctggtttctgtgtaagaatacttcatagttgctcatcttgttaagaataatcctaagcgagtgattaaaagtaacacatatttgcactaagtaaattacttaaactttacttaagtaaaatcttatgaaagtggcccgttgaaattttgtcaatcttctgtaaactcgcagcttatgtttacaaaggaattgtgatttcatacctacgggcaggatatacctggctcgtgcggtagctatgagcttatacacatattgtaacttactgaatgtgatcgtaaaaacaggaaaatcagtctatgcgctgcgcttttttcttttgtcagcgaatagcgtcacaagtgtaaatctgagtcaatatgtcagttttcggccagggatggcataagtaaagcttgggttttgcctgcctcatccaatctgacggaaaaaaatagatcatgtttctgatcatttcttgccagctcagatttctcgctgcaaccgtcccggtcgccatagttgctttttaatagttaactttagttgatcttttaacgtgcctcgccatggcactttaacgctatttgcttaaggtttttcttttaggctggcactaagtggcgctctatcagcaccacatccccgattttcattactgacaaccggcctctggccactctccaggatatgaatggaacacaacatgaaaaaaatggtgaagctccgtattgcgttaggcctgatgtttgttttttctgtcgcgggttgtaaaacgccgccaaaaatgacggatgacacgctggtcaccagcaccgtggatggcgtggtgatcagtcatcgttatgcggttaaaccgcctgcgcagttcagcccggtcaatgaaacctaccgtgcgctctatcccgcttcggtgatgagccatccgagttttggcggcaaggtggtggagacgctgaaaaccggcgaaagctacaccgtgattggtcaggtagagaacaactggttggcgctgggtgaacccgctcaggcgtcagcagaacctgaaccgggtaaagccagcagtgccgttaaagagtcaacgccctccgcagcaccgcaggcaactgttcagctgaccggctatgtgccatttcgcgccgtggtgaaaagcgagctttacgatcagacgatcaaggctgaccagccgaagcgccgggtgcgcagcagcaagaagaaaacctgtgttgcggtaaacggtgacagcaccgcctgccagaaacagcactaacggaacctggattattaactaatcgcactaagcagggagggcgggatgatgacaacaacgcaatggcgtggggcgctgatagtgctgctgacgtggctgatgaccgcgtgcagcagtactccacagcccgttgcctggtacaacctggacgttcaggcgcaaaaccaggttaacggcggtgcgccgctgaaagtccgggtggtattactgacctccgatgcggagtttatgtcggctgacttctactccctgcaaaaccagtccgctaccgcgctgggtaatgcgcaactcaatacgcaacagttcttcctgacttccactcagccccataaaacgctgcggattaagagtctgcccgaggcgcgcttcatcggcatcatggcggaatatcaggcgctggatggcaaggtctggcgactgtcgctgcaggttcccgaaggcgaatcaccctcattctgggcgttctggaagcgtgacgatggtgagctgaatgcgcgcattgtggcggggattaacggccttcgcgtggaaaaacagtgatgtctatgaacagagccgaaaaggtggtctggaccgaggggatgtttctgcgtcctcaccatttccagcagtcagaaaattatcttctcagcaccctgcgtgagtggggccagtcgcagcgcgcctatacctggggtttttacgatctggagttcgatgaagcgctgctgcgccaggggaaactggcgctgagcgccgccagcggttgtctgcctgacggcacgttttttgccttcagccagccacagcacggtccggccccgcttgatctgcctgcctccgttgaccgcagcaaagtggtgctggccattccggcacgccgcaatggccgtgaagcggtcgcctttcaggagtcgcaggattctctggcgcgctacctcgcctgggaagcggaagtggaagatgacaatgcccaggccgtgggcagcgccacggtgcagttcggcaaactgcgtctgcggctgatgctggaacaggatctgaccgccgagtggaccgccatgggcgtggctcaggtgattgaaaaacgcagcgacaaccacatccggctcgacagcgactacatcccgccgatgctgacgcttaacagcagccgtccgctgcaaaacatgttcaacgatctgcacgggctgatccagcaacgcagccagcagctgagtcagcgcgcgccgggcaccggtcgttttaacagcgcggatatggtcgattttatgctgctggcgctgctcaatcgtcagcttggcctgcacactcacctgcaacatctgccgctgctgcatcctgaaacgctctacagccactggctgcaactggcggcggagctcagtacctggacgccagcccgcgcgcccgatggcctgccgctctatgatcatgacgatctgcacagctgttttagccgcctgtcactgctgctgcgtcaggggctgtcccaggtgatggaagagagcgcgattcagctgccgctgattcagcgctcgcacggtcttaacgtcgcgaccgtgccggagagcagtatggtgcatgagtttggctttgtgctggcggtgaaagccagcgtgccagccgacaccctcaaaacccacttcccggcgcagatgaaagtcgccccggtcagcaaaattcgcgatctggtgcagttgcaattgcccggtctggcacttcgggcgatgcccggcgcgccgccgcagatcccgtggcatgccggatacagctatttcgaactggataagaacagcgagctatggaaagagatggagcgctcgggcgcttttgcgctgcatcttgccggtgagtttccaggtctgaacatggagtttctgggccattcgtagtcagtcagaatcataaactgagcacgcagcatgatgcaggaacaacaaaaatcacacagcgatcttgcgccggaggccagccatcagaatgtgctggtcgcggcggccaaccccctgattaacgccattcctcagatccgtcactcggtatcacatgaagacccggcgcagctgcgtcagcagctgatcgatcagattcggcgcttcgagctgagctgccagcagtcaggcctgggctatgaagtgatcatcggtgcgcgatactgtctctgtaccgcgctggatgaggcggcggcgctgacgccgtggggcagccgcggcgtctggaccagcaatggtttgctggtcacctttcacaatgaaacctggggcggcgaaaagtttttccagctgctggctaagctgtcgcagaacccaagacgccacattctgatgctggagttgatctacttctgcctgctgctggggttcgaaggacgctaccgggtgctggacaacggtcgctcgcagctggagaccatcaaacagcgcctgctgcagatgatcaaaagcgtgcgtggcaattatgcagcggcgctgtctccgcatcccaccgatcagccggtcctgcgcaaattgtggcggccaatgatcccgctgtgggcctgtgcggcggtggcggggctggcggcctgcctgttctatatcgtgctcaactggcgtctcggcgattacacctcgccggtactggcccgtatctatcagacggcgctgccggaagtgaagatcggcaaccctgcgccaccaccgcccgccacgctgaacctgcgcgctttcctgaaaccggaaattgatgccgggctggtagcggtgcgtgacgaagcggaccgcagcgtggtgacgctgaaaggggacggactgtttgcctcggcggccaccgaggtgcgcggacgttacaccgacgtaatccagcgcatcgctgctgccatgaacaatgtcagcggccagattcaggtgattggctacagcgataacgtgccgatccgcagtgcccgcttcgcctccaactttgagctttcgctggcacgtgcccggtcagtacagaccctgttgcaacagcagctggcgcagccgtcacgggttaaagcggaagggcgcggtgaaagcaatccgctggtgcctaataacagcgcagaaaatcgcgcacgtaaccgtcgtgttgaaattaccctgctggtggcaccggatgcgacgcatgccgaactcaacggcctggcgagagggaactgatccatgctgaatatcctgtttgcggtgctgaccagccgcctcgcgtggggctttgtcggcattaccgcgctctcttttatcatctgggtgattggcccggtgttctcaatcgtcgattcgcgcccgcttgagccggagcagaaccgcattatcagtatcgcgctgctctatctggtgtggggcttaggccaggcgattccgcggctctataacatctggctcaatcgcaagctgatgtcgagcctcgaaaccggcaaaagcgatgcgccggaagccgatcgtcagcgcctgaccagtgaagagcaggtgctggcagggcgtttctccgaagccactgacatgttgaaaaaggcgcacttccagcgccacagcagcaagggcacgccgtttctgggcacagcgctttggccgtcagtatctctatcagctgccgtggtacatgatcatcggcgcgcccggtgccggtaaaactaccgcgctggtcaactcggggctgcagtttccgctggcagataaattcggcaagtcggcgctgcgcggcattggcggcacccgcaactgcgactggtggttcaccaatgacgcggtgctgctcgataccgccgggcgctacagtacccaggagagtcagcaggagcgtgatgccagcgaatggcatcattttctcgacctgctgcgtaaatatcgcggacgtcagccgatcaacggcgtgatcgtcacgctgagcgtttccgatctgctgtcgcagtcgcccgaggcgctgcgtaatcaggcgctggcactgcgtcagcggctgatggagttgcacgatcgccttggcatccgtttcccggtctatgtgctggtcaccaaagcggatctgctcaaaggcttccgcagctactttgcctcgctggataaagcgcagcgtgaacaaatctggggattcacctttccctgggcgaaggcgtccgccgccgatttcgaacttaataaccagttccagcaggagtattccctgctgcaacagcgtctggatgccggactggccgatcggctgctgacggaaagcgacgcgcaggcgcgggcagagagctatctcttcccgcaggagtttgcggcgctgcggccgttgctggcagacgcgctggatacgctgtttgcccgctccgattttgaaacccagttcgcgccgcgcggtatctactttgccagcggcacccaggagggactgccgtttgaccgggtgatgggcgagctgaaccgcgcactgaatctgccggggcagcaggctggcgagtcaggaagctgggataaggtcgataaagagtcgcccatcccgcagaacaaagggcagagcttcttcctgaaaggggtgctggaaaatgtgattttccaggagtccggtctagcgggcagcaaccgctggtgggagctgcgcaaccgcgccgggctctggtcgggttatctggcgctgctgatggtattgctggtggccggggcgctgtggctcaccagctacagtaaaaacaaagcctatctgcaggagatggccgctaaagcgccgcaggttgaacaactgggcgatcagcttcagcagcaggtcaatggcgatctctttgcgctggtgccttatctcaacaccctgttgcacctgccggagagcgccgacttctcactggaagcaccgccgctgacgcgccgcatggggctttatcgcggcaccgaggtcagcgatgccacccgtgcgctctacgacaaggcactgaaacagctgctgttgccgcaggtggcgcagaacatcacccgctggctgcgtaatgacaacggcagtgatgctgactacagctatgaagcgctgaaagcgtatcagatgctctaccagccaaagcactatgatggcaaattcctgcaggcgtggctgatgctcaacctgtcacgcgaactgccgcagaacgttacccagcagcaggtgaaacagctggcgtggcacctgcaacagttgctggagacgcagattcactcgtcgccgtatgcgaaggatgaagcgctggtaaagcgcgagcaggcgctgattaatcagatgccgctgtcacagcgcgtctatggacggctgaagcgcctgctgcaacgtgatgacagcctgcagccggtgacgctggcggcgctgggtggtccccagagcgagctggtgttttcccgcaaaagcggtaaatcggtcaatgacggtgtggcgggtctctatacgccggatggctactggcagcacgtggataagcagattgccccggtgacccaggcgttgtatcaggacgatctctgggtgctgggcggcgcggcgcctcagcagaaaagtgagcagacggatcttgcggtgcgccagctctacgtgcaggactatatccggcagtgggagcagttcctcagcgacattcagctcaacagcagcgccgatctctcgcaacgcatcaacaccgcccgtttgctgtcgggcaaccattcgccgctgcgccagctggtgattaacctcggtggtctgctgacgctgaaccgggcgcaaccggatgagaaaaccgcgcaggcagcaaagccgtcggataacagcgccacccgcacccttgaagcgctgtttacctcgcccgaggccagtgccgcgcgcggacaggccgccacccaggcatcaccggagcaggccgtcgcgcttcactttgcgccggttctggagctggcccagccgctgcagcagggcagtaaggtgctggcggtggatgacttcctgcatcagattgacgatctctatcgctacctcaccgccgtgcaggatgcggcgaacagcgggatgccgcccccggccagcgatgccatcagtcgtctgcaggccagtgccggccgtctgccgggttcattgcagaacatggtttccagcatggcggtgggtgccagcagcgacgcacagcgccgcgatatggataacgtccgcaaacgcatcaccatggaagtgggcagtttctgccgccaggcgatcgcgggtcgctatccgctggttcgctctgcgcgcagtgaggtcacaccagacgatctggcgcggatgttcgcacccggcagcggcatgatggacagcttcttccgcgacaacctggccagcaaagtcgacaccaccaacccggcgtggcgctttacgccgggcattgacggtaaaaccctgccgggaggcgaagccctgctgcggcccttccagcaggcgcagtcaatccgcgatgccttctttgccaatggtgcgaccacgcccggcttccgcgtcacgctgcgtacggtaaaaatggataacgacatccttaacctgacgctggatgtggatgggcagattttacgctacagccacggaccgcaggcggtacagatggtcagctggcccggccccggcggcaccagccaggtgcggatgcagctgggtctgaccaacggcaccacctccacgctggtcaccagcggtccctgggcgctcaatcgcttctttgaccgcgcccggctgacagcggcaggcggcctgacccgcgaagcgagtttcagcgtggacggtcatcaggtcacgctgtcgttcacccctggcagcattcgtaacccgttccagcttcccggctttagctgcccctgaaacaggacccgacaatgactcattacgctgcaccctgctggtacggcaaagtgcccagcgcgggtgactttgtgaagcgccgcttcccggacgtgctctatcgccaatggtccagctggtttcaggtgggcctgcatcactggcagagcagtcaggagagtgataacgccccgtcgcgcccgttcctcaacgcgccggtctggaattttgtggtgccgccgatgctgggcagtcagctgattcagatgggctgcctgattgccgcgcgtgacagcgtgggccgtaactacccactctgcgcactgcgccacttcacgcccgccgagtggtcgccagccctgctggcgcgctccggcgagtggtatcagcaggtgggcaatacgctgttgcgggtggtgcagggcggcgggtcaccggagcagctggatcaggcgctgatcagcattcctcagccgcagccgccgcaggagtcggacgagacgtcagacattctcaacgtcatcgggcatggcgataccccttcgacactgaactggacactgccgggcgagaacttcgacccgcagttctacaccagtttctggtggaccaatcaaagcgacggtttcccgctttatacccaggttcacagcggtaattttaccgcccagctcttttcattgctgtttgatccggccggtggggcaaagccgggacgaaacggactttatcccccgatgtttgaatcctgaggcgacacgcatgacgatgaatacagaggctctgctggctccggtcagcgaggacaatcccggcggcgataacctggagtaccacgccgattttcaggcgatggagcaggccagcgccggtaaagcggagcagcagttcggtaataccatcattccggcagaaaaccggccgactggaacagagtcgagaagctggcgatagcgctgctggcgcgcagcaaagatttgcgggtaatgctggcgctgacccacgcctggaccgaactgaaagggctgccgggctatgcccagggcctgaagctgattgaacaggcgttgttgctctactgggagccgctgtggccccggctggaggagttcggcgagcaggatcccttctaccgcattaatgcgctggcgttgctgggtgacaaaactgatctgagcggcgcggtgcgtcagtgctggctgctgcgctatccctctgacggcatcacgctgcgcgatgcggccgccctgtgcgacggcagtaaaaccgaagtcgcggactatcctggcggcctgccgcgtctgatcgacgaactggcgcgcggcgaccagcctggtattgaggcggtgctgcagattcatgagcggctgcagaccatctgcgaaaccgtgaccgaacgactgggcgaagccgcggtgccggagctcacacagctgcgcagacagattgcgctgatcgctgaacgttgccaggccaccgatctgaatgcgctgatccccacagccgccgtggaacagcccgcagaaaccacggcatcgcctgcaccggccagcccgcgcgctgccgctgactggcgcacggtgcagatcagttcccgcgccgacgcgcagctgatgctggagaaagtgaagctctacttcaaccagcatgagccgagtcatccggccccgctgatgatcgaccgtgtacagcgcttaatcgagcgcgactttctggagatcatccgcgaactggcacccgacggcgtacatcagctggaaaccattttcggacgtcgcgattaagcaggcgtgacgcacacacactcagcgggacctgcgcgcctgctgtgacactttatccgcgcatcatgtatggagaaaaccatggcaacaagcaaatccagtgggcagaagttcattgcccgcaatcgcgcgcctcgcgttcagattgaatatgacgtggaaatttatggcgcggaacgcaaaatccagctcccgtttgtaatgggcgtgctggcggatctggtgggtaaaccgctggagccacagccaggcattgatgaccgtaaattcatggaaatcgacatcgacaacttcgatgagcgcatgaaagcactgaagccgcgcgccgcgttccaggtagacaataccctgaatggcgaaggcaagctgaacatcgatctgacctttgacagcatggatgacttttcgccggacgcggtggcccgcaacgtggagccgctgagcaaactgctggaagcgcgtacccagctggcgaacctgctgacctatatggatggcaaaaacggtgcggaagagctgattggtaaggtgctgcaggatcctacgctgttgcaggcgctgacccatctgccaaagcaggatgaggccactgaaggtaaggagccgcaggcatgacgcagacttcacaacaaccgcagtcgcagggcgcagccagtttcagtcaggatgagttcagtgcgctgctgaataaagagttccggccaaaaagcgatcaggcacgtgctgcggtcgaaagcgcggtgaaaaccctggcgcagcaggcgctggagaacaccgttaccgtctccagcgatgcctatcgcaccattcaggcgctgatcgcggagatcgacgaaaagctgtcgcagcaggtgaaccagattattcaccatccggagtttcagtcgctggaaagcgcctggcgcggcctgagctatctggtgaacaacactgaaactgacgagatgctcaaaatccgctttatgagcatctccaagcaggagctgggtcgtactctgaagcgttacaagggtgccggctgggatcagagtccgctgttcaagaaaatttatgaacaagagtatggtcagttcggtggcgagccgtttggctgcctggtgggcgactactactttgaccacagcccgcaggatgttgagctgctgggtgagatggcacgtatcggctcagccgcgcactgtccgtttatcaccggcaccgcgcccgaagtgatgcagatggagtcctggcaggagctggcgaatccacgcgatctgaccaaaatcttccagaacactgagtatgctgcctggcgcagcctgcgtgagtcggaagatgcacgctatctgggcctggtgatgccgcgcttcctggcgcgtctgccttacggcatccgtaccaacccggtcgacagctttgactttgaagagcagaccgatggttccgatcatggcaactatacgtggagcaatgcggcttacgcgatggctgccaacatcaaccgctccttcaaagagtatggctggtgcaccgcaatccgcggcgtggagtcgggcggggcagtggaaaatctgccgtgccacaccttcccgagcgatgacggcggcgtggatatgaagtgcccgaccgaaatcgccatcagcgatcgtcgtgaagccgaaactggcgaaaaatggctttatgccgctggtacatcgcaaaaactctgacttcgctgcctttattggtgcgcagtcactgcagaagccgatggagtatcacgacgccgatgccaccgccaatgcccgcctggccgcgcgtcttccgtacctgttcgcctgctgccgtttcgcgcactacctgaaatgcatcgtgcgcgacaagatcggctccttccgtgagcgtgatgaaatggaacgctggctgaacgactgggtgatgaactatgtcgatggcgatccggctaactcctcgcaggaaaccaagtctcgcaagccgctggcggctgccgaggtgaatgtggaagagcaggaggataatcctggctattactccgcgaaattcttcctgcgtccgcactaccagctggaagggctgacggtttctctgcgtctggtctctaagctgccgtcgctgaaaaatgacaatgcgtaagggctgaaagggagtcgtgatgccggggatgacctggcatcacgtttccgctgagtcacagagttaacaggcgcgaaatggttttacgcctgatgcctgacacaaaggttgctgagataaagtcagggaggatgacaggatgcttaagaagtcagctctgcacctgctgcattatccgctggtatttatttctgctcttattttaataacctgtgcaggttattacattttctcactggagtattgtagtgcgaggaaagtttgttaacgaagttctggttaatgtttctatggatggcgtcaatatcgctttatgccgtagcagaaaagttgaaacaaattaattaaccggctttctgcgcgctattttaattaaaataaaaacaaaggccaggcagccagcggtaaagagaattttaccggcaatgagaccggaagaagagagagtaaattcttcatagcgagcaaccagatatatcgaaccaataatatcagcgatgacgtaaagagaaagcagcgacaacacgactatcaggaaaagtgagatgatctttttcatgttcattccttctgtgaactttttaagcgcctgcctactataaactatcggccagaattatgtctatgaaatgaccacctgaaagcgcgggatgcagcagggtatcaggttatcgatgttggcctcgccatgaaaaacgcatactgatttttgcctggttaaataactggcaatacgacgtctgaaatatggtttatgacgatatttcagaagcaaggcaaaggtaaaatatggactgttttattcagccccatgcttttctttttgccatatccttgcttttttgaaagcaataatctcaaccaataaagagtgaaagataatggctattgatatgtttatgaaggttgacggagtcaccggcgagtctaaagactctaaccactctggctggactgatatcacctctttctcatggggtgcttctcagccaggtaatatgtctgttggcggcggcggcggcgccggtaaggttaacttcaacgacctgcacgtcaatgcactgatcgacaaatccaccacggcgttgctgaagaactgcgcaagcggtaaacacctcgctaaagttgaactctcaatctgtaaagcaggtggctctcaggttgagtatgcacgcattaccctggaagacgtttctggtgaccgctgtgaattacaatggctccgacaacggcgacaccctgggaatgacctactccttccaggcttctaaagtgaagcagcagtactgggagcagagttcttccggcggcaaaggcgcagagagcagcgccggctgggacatcaaaggcaacaaagaagcgtaatgttttatagccgcctccccttcgggggaggctttaaaaggagttctgctatggcacatttgagacctcagttttcggccgcctggaatcgcttctctgaagtcaatgttggagtagagaaggtgggggaaatactgggtggaaaagtagaggcgaatatcaccgccggaattttcgagaatgcctgcccaataagaatgagctatgttcttaattacactggtgtttctgttcccgcaaacagccgttatgcgaccgtaacgggtaaagacaaaaagcgttatatgtttcgcgtcaacgatatgatggactttttagtcggtgcgtttggtcagccagacctgactgtgacctcaccaaaacccggctcatttaacggtaaacaggggattattgtgtttcaggggagtggctggagcaatgcccgtgggcacgtgacactctggaacggcaatatctgctctgatacctgtcacttcctgggtggcgcagaaaatggtagttttgttcctgatgttgcctccttgtggatactgaaatgaaaaaattcctgatgttatttgctctgactttatctcctgcggcgctggcgataacgccaccggcgccagactcctttaagcaaccggagattttcagcaactggcttctgaaccgttgtgcaggaaaagctgcgactgacaaggctttcaccgatgatgcatttaaaagcgcgtcagcctggttagaggtaagtcatctccctgttgaagcattcagtgatggtgataagttaatcaatgagtatctgaagatgaacctgactggctcggtcacaggaaacttcaatatgatgaaatgcacgttgctttcgcaaagtcaggatgcaaaaactctctataataagtataaaaaatagatatctcatatgaaaaattatttatttttaatgctgtgtgtctcagttatttacgttcccctcgtccacgcgatgagtgattgctcaaagggaaataacgttcaggaagttaatgaatgtgcagaaaaaaataaaacagagtcagagctgaatttaaataaagagtacaaggctgcgaaggctcgaattgagaaaatttataagggccatggtgaggagtcaagccagtacagaagcgcctttgttgatactcagcgtaactggcttaaataccgtgatagtcagtgcggtcttgaagcctatgccgctgaacaaggcagcgatgcttatgtgagtgccataaatttctgtattgaccgtctcgatcaggaacgcaccgcgattctgaagcaattgccttattgattatgcctctggctcatttctttcccggcctgacacactcttcatagcggatggtgaatgttgtggtgcagtgtcaggccaaagccttattgccaccagatgatcttgtttaaatgaaattcatacaggccaatcattttttatttttataaaatcaatgcctattcttttccgtattaacgttatgccattttaattcgaaaatttataagctgtgatgtaatgcatttaatttgttaagcagttgctctgttaatttaattaataaatttatcgccactattatttaagataaaaacaactcccaaaattaaatccccccgctttctataccccgcgcctttcccgagaggtgcgcggtatagatgccgaaccgctaaccgcaggaatccgttatgcgctttacgataataacgactaaacccggccaacagccgccgcaaactcattgtgatttctttccgcctggcggcaccattggtcgtggtgtggataataatctggtgctgccggatgacgatcgcacactctcccgcctgcaggcgattgtacacatcacggcaaatggcgaatgtcgcctgaccaaccgtggcaatgtgacgcgcgtgttactcaacgatattccgctggaacgcggacgtcaggttgagctgcaggatggagacatactgggcatcgatgattaccaattgctggtcagcgatctcaacagtgcgcagcaaccgcagagtgaaagagctgttccgcgtcctgagccggtgcagcccgtagcacccgtttcgcgaaccggcagcggaaaaagccagcaccaccgccgccattcccagcgaaatctgggacagcctggcgaaggagttttcgatttcggacgatctctctaaacgcaaagctgcgccagagatgcctgaggcccatccgctgactgcgcccgctcgtcctgaccgaaatccggaagatccgctggctcagctgattaacgatgcaccgctggattatggtcagcagccaaaaaacagcagcctgtttgatgaaggcgatgcgctgttcgggcagcagagtatttttgacgaccggacgccaagcacgctgtctgctcagcagaatacagcgccaccgcaggctgaaacgcctgccgctgaacttgatccgttgagcctgtttgacggcgagagcagcacggatgtgcgcaaccatgatgatccgctgggtctgatgatgggcaacgcggtgccgctggcgcagccggagctgacgacgccgaaaccggccacgttgcatgtgccacctcaaccggtggcaaaaaatgagccgatggccgcacatccatcggagcaggctcccgcgagcctgaccgacatggatcattcaccgctgttcagcttcgacgaatcacagcatgagactcacagccagcctcaccctgaggcacagcagcatacaccgctgattgacgaggaactgcccggccagtctgacgcggtaaatccacagatcgattacggcggaattacgctgcccacgccgcaggcggtacagcgtacgccatccccgacgccgaaagggcggttgcgcatcgatcccgtagcttccggtcgccatcatgccgccgctgcgcacccgacgacacccagcgaaagcagcggtgatgccctcaagggcgaactactggatgcgttgctggagggaatgggtctgcgcgacctgcaaccgacgccgcaatttgaccgtgagcagatgctgcaattcgggcagatgctgagcatgttttctcagggcacggtggcgctgctctcatcgcgttcgatcctcaagcgcggggtaaaggctgacatgacggtgatcctcgacgacgccaacaacccgttcaagctgctgccttcaggcaaaaccgtcttaatgcagatgtttggcagccggatgccgggctttatgccgccgcgtcaggctgtgcgtgatgcgctgatcgatctgcaggcgcaccagctgggcatgatcgccggtatccgcgccatcatcgcctcaatgctgcaatcctttaacccggagcagctggaggaggaggcgcgtcaggcgggatcggtgtcacgtatcggcctgccgggcagccgtaaagcggcgctctgggagcattttgttgagcgctacggcgagacggcgggcgagatcgaagacgatttccacaccctgttcggcgaagcgttcctgcacgcctatgacctggaagttaatcagtacaaagactcacaaacccacacggatgacgcatgaatatcactattgcctcgacgtcgaatcagggcgatcgcgccagtaaccaggatcagatcggtgatgtcatcggtaagcgctcggcctgctttgtggtctgcgacggtgtagccggatttcccggcggggacatcgcggcatcgattgcccgtagcagcctgctgcagtcgtttgatggcgatgcgcatctcaatgcgcagtcgattcgtaactacgtcaatcaggcgaatcacgccatccgccagcagcagaaagccagcagcgaacacagccggatgggcactacgctggtcagcctgtttattgaccgcgactaccatctggcctgctgggcccatgcaggcgacagccgcctctatctgttccgtcgcggctatctctatcttgtcaccaccgaccacagcctggtgcagcagatgaaagatgccggacatcgcaccgaaggcatcaacagcaatctgctctattttgcgctggggatgggcgatgagcagcgtgacgccagctacagcgaggtggtcgggattgaagatggcgacgcctttttactctgcaccgatggtttctggcacggcgtgacgctggaacagatgcagcagtcgctgcacatggtgaatacgccggaagagtggctgacgctgatgcagcaaatcatcaggaacgatcagccggatcaggggcagcaggataatttcagcgcgctggccgtctggattggatcacctcaggacaccaccttgctgcactcgctctctgaagcggcgcagttcttccctctgcgagattgagaacgccaacatgaaatatggattactgggtctggctgcgctgctgctcagcacgcaggcttatgctgaaaactatcgcatcgtacagtccccggcacagaaactggatgtctggattgatgacgtaaaaaacaatcagctgtcgagctggtgtaacagcaccattaacctgcgcatcgtcacgctgggcgaaaaaaacgccgcggtgctgaaagattttctgccgcgcgttgccggactgatggcgtcacagtgtaaaccgctgcaacagttgcactggcaactgaccgatgcgcaggggagtgaaatcgctactggcagcgccgcccgtgcgcagcagtggaaaaccgtggtgacgccgcccgcgactcaaccggtccggccgacggctacagcggtccccgcagacgcactacgcaacgccgctcaggccgacacgtcgccgtggctgcaattcagtctgctggacggatgccatttccgtacctggtggcagcacccggcacagggcagcgcgctgtttgttccggcaaatcaggggctgatctgcggttcggatggctggctcagcggacacagccgactgacgcaacagggtaacggcgcacctgcggcagtcggcgtgaccttcctgcagggttttccggtgatggggttgagcaatcagtcgcccactgccgaactgcacatcaccacggtcaacagtgaacgcatggtgctgagcaatgaaaaatccccggatagctggctgattctgccgttcagcaaccgctttaacggctggcaggcaacgcgtcaggtggtggtgcagatgcccgtcagcgaagccgccgatcagagtgcgctgcaggcgcgtctgcaggaagtccgtaaagtctggtcgccgtggatcagtggcgatgccgcactgagcgtgcagctggtggaaaaactgcatcctgaactgaaagatcccgccgctgcggtttaccgcacccttaactgacgcaaaaggagtttgcatggaatccttacaacaccgtctggccagcgccaccctcggcgagacgctcgctgacgtgacccgccagattcaggcgaatccggcgaatgctgacctgcgggccgcctttgtgcagctgctctgtctttcaggcaactggtcgcgcgcgcaggcgcagctgcaatcctggctggcgttaagcccgcaggcgcaaccgacagttaatctgctgcaacaggcgatcgccggtgagctgcagcgtgacgcggtgctgcgtggccaggccgacccggtgctgccgggcagcgcctggcactggtgcgacacgctgctggccgccttgcaggccgaaacggcgggtgatgtcgcgcgcggcagcacgctgcgggctgaagcgcttgagctcgcggcggccaatcccggcaccgcaacgcagcaggatcagcccaccgcattcagctggctgatggatggcgacagccgtttcgggccagtgtgtgaagttatcagtcagggccgttattactggatcccgtttgccgccattcgtgagatgcagtttcaggcacccgccagcgtcaccgatctggtgtggcgtcacacgcgtgtgcagctggttgatggcagtgagcaggtgtgccagatcccggcgcgctatccgctgctggcggcatctgacgaacgttttctgcgcgccagcgtcaccgaatggcagccactgggcgacgatccggaccagttcatcggtcaggggcagaaaatgtggctcagcgacagcgcggaattttcgctgctgagcctgcagcaggtcgcgtttgacagcgttgagtccgccgatgagccatgattcaggcgcgcaaaacgacggctatgcccagctgcatggcggctttcgcgcgcgtaaaaaacgtgatgcgttaaccgcccgcgacaagctgcaatcctcgctgctggatcgcctgaccgacaacgcgccggataaacagcaggaagcggacaacagcatgctgatcactcacagcacgctgcgccgccacgtactgcgcgatctgcagtggctgttcaacaccatcaacaacgaagcccagcaggatctcagcggctttgatcaggtgcagcgctctgtctggaacttcggtgtggcaccgctggccgggcagaacgtctccgatatcgaatggcaggatatgcagcgcaaaatgaccaacgccattctgcacttcgagccgcgcatcctgccgcagggtttacaggtgcgctgcgtcagcgatctcggctcgctcagcctgcacaacgtgctgtcgattgagatcaaagggcggctctggtgcgtgccttatccgctggcgtttctgttccgcactcaggttgatctggagagcggccatttcgaactacaggatgcagggtaatcatggacagcaatctgctcgactattacaaccgtgaactggcctacctgcgtgagatgggggccgagtttcgctgcgcgctaccctaaagtggcaggacgtcttggcatgcgcggcattgacgtggcggacccctatgtcgagcggctgatggaaggttttgccttcctgacgtcgcgcgtgcagctgaagatggatgcggagtttccgcgtttctcgcagcgtctgctggagatgattgcgccatcctatctctcgccaacgccgtcaatggcgatcgctcagctgacgccggacagccgcaaaggcgacatcacgcagggctttcgcgtgccgcgcggcaccatgatggagagccagaacctgaaaaaaaccggcgtgacctgcagctacaccaccgcgcacgatgtggtactgcatccgctgcgcatcagtgaagccagtctcggcggcgtgcccggcgatctgccctctggcgagctgaaactcggcggcctgggcgcggtcagtgcgctgcgtatccgcatcagctgcgaagggatctcctcgctcagtcagctcagcgtggacgatttgatgctgtttctcagcggcccggatatccaggcgcttaaactgctggagttgctgatgcagcaccgggtgggcatcgtgctgcagtcggttgagaagcgtccgcagcgtcaggtgctgacggacgacgcgttacagcaggagggctttgcgccggagcaggcgctgctgccggacgatctgcgcaacttcgacggctatcgtctgttgcaggagtatttcgcctttccggcgcgcttccagtttatcagtctgagccagctggccccgtttctgcgccgctgcgacaacgccatggcgttcgacatcattattctgctcgataaagcggacagcgcgctggaaagcgtggtcgatcacagccatctggcgctgcactgcacgcctgtcatcaatctgtttccgaaaaccgccgagcgcctgaaggtcagcgacagccagcatgaatatcacctggtggtagataacatccggccgctggattatgaggtgcactcggtacagcggctgttcgctacggtagagggcaagcgggaagagcaggttttccgtccgttctggagcaccttcagcggtgaccagggcgattacggtgcctatttttcactgcgccgcgaacagcgcacgctgtccgagcaggcgcagcgctacggcacgcgcacgggctatatcggttcagaagtctttctgtcgctggtggatgagcatcacgcgccgtggcacgacgaggtgcgctatctctccgctgacgtgatgtgtaccagccgcgatctgccgctgatgctgcagcaggatcagggcaacttcgtgatgccggactccattccggtatcggagctgaagctgtgcaaagggccgacgcctccgcgtccggcgctggccgagggactttccgcgtggcggctgatcagccatctgcagatgaactacctcagcctgatggacagcagcgacggagaaggcgcggcggcgctgcgccagctgctgagcctctacgccaacctggcggaagcgccggtcgcacgtcagattgacggcatccgccactgcacgctcagcgcggtcaaccgccgcgtgccggagccgggcccggtggtgtttgcgcgcggcgtcagcatcacgctggaagtggatgagcaggcgttttcgggggccagcccgtggctgttcggcagcgtgctggagcgggtctgtggccgccttgtggcgctcaacagcttcacggagttcaccctgaacagccagcagcgtggagaagtgggctactggccgccgcgcatgggccggaaagcgctgatatgagtggcgaaaaggtgatttcgctgccccggctcacccgtctgccggatgatttctggcagcgggtgatggccgcgccgtggcgctacgatctgttccagctgctgcggcggctggatgcgcagggcggtcagcgctatccgctgggccgtgcgccgctgccgaagttcgaatcggtgcgtatcggtcagacaccgtcactggcgtttgcgcccgccaccgtcgccagcgccacgccgcgtgacgaggcgggacgtcatgagctatccatctacagcttcggtctgtttggccccaacggtccgctgccgacccatctgaccgaatatgtgcatgaacgtatcgtgcatcatcaggatcacagcctgtcggcgtttgctgacctgtttcaccatcgcgccacgctgcttttttatcgtgcctgggccgatgcgcagccgaccgtgtcgctggatcgccccgacgacagtcgcttccttaactatctcgcctgcctggccggcatcggtttaccggcccagcagcaggccagctcgctcagcctccatgcccgactgatgctggtgggtcacctcagccgccacggccatgatgccgaagggctggtgcggattctgcgccactattttggtgtgccggtcaggctgacgcagaacctgccgcactggctgacgctggacagccgcgatcaggcccgactgggcgcgggacgccatatgccccggctgggcgcttctgcatttctcggcgtggcggtgcgcgatgtgcagcaccgttttcgcctgcacctgggaccgctcagcgccgcgcaatatgcccgttttctgccggatgcccccggcgcgtgtgaagtacgcgactgggtgcgtcactacctcggcattgaaatgcagtgggatctcagcctgatcctggccgctgacgaggtacagggtgtgacgctgggtggaactgcccgactcggctataccagctggctggggctcgcgccgcagccgcaagatcgtgaagattttatgtttgaggttgaggctgcttcgcgctagcccagccgctttccctgttacacagcctgcgtctttcattgaagagagccccctatgtcagaaatcagccgtgccgtgctattcggcaaactggatacgctgttatttacctcgctggaaagcgccaccgccttttgcaaactgcgcggcaatccctatgtcgagctggtgcactggctgcatcagctgatgcagcagcaggatggtgacttacagcaggtcatcacacatttttcactggatgaaaaggccctgactcaggatatcgttgccgcgctggatcgcctgccgcgcggtgccagtgcggtctccgacctctccgagcatatcgacagcgccgttgaacgggcgtgggtttacgcctcgctgaaatatggcgcgacccgcattcgcggcggccatctgcttatcggcatgctgaaaaccttcaacctggccagcgtgctgaaaggcatctccggtcagttcagccgcgtcaacgccgatgcgctgctggcggagttcgacacgctgctcagcaacagcaaggaagcacagcaggtgctgagcgcaccggcggatgctggcggcgcaccgcccgccgccagtggcagtacgctggcacaatatgcgcaggacctgacggcgcgtgcccgtgaaggccgcattgatccggtaaccggacgtgacgacgaaatccgccagatggtcgatatcctgatgcgtcgccgccagaacaacccgttgctgaccggcgaagcgggcgtcggcaaaaccgcggtggtcgaaggccttgcgctgcgtatcgcggcgggcgatgtgcctgcgccgctgcgcgatgtgcagctctggctgctggacatcggcatgctgcaggcgggtgccggcatgaaaggggagtttgaagcgcgactgcaggcgctgatcaatgaggtgcagtccagcccgacgccgattgtgctgtttgttgatgagatccacaccctggtcggggcaggcggtcagcagggcaccggtgatgccgccaacctgctgaaaccggcgctggcacgtggacagctgcgcaccatcggcgcgaccacctgggcggaatacaaaaagtacattgagaaagatccggcgctgacccgtcgcttccagaccgtgcaggtgcaggagccggatgaagccaaagcgattctgatgctgcgcagcaccgtcagcgcactggagaaacatcatcgggtgctgttgctggatgatgcggtcagtgcggcggtgaaactgtcgcatcgctacattccggcgcgccagctgcctgacaaagcggtggcgctgctggataccgcctgcgcccgcgtggcagttagccagggcgcgcagcccgcggcgctggaagattgtcttcaccgtctggcggcgctggagattgaagcagagatcattgaacgtgaaatccgggtgggcctgggcgacgccacccgccagcaggcgattgcagcgcagcgcactgcgctggaagccgagcgggatgcgctgcaacagcgctggcggcaggagcgcgaactggtcgagacgctgattgcgttgcgcgcccgctgtgtgacagaagaggatgcggcgctgcgtgaacagcgtgatgcgacgcagcagcagcttattgcgctgcagggcgacacgccgctgctgtttgccgccgtcgatgcgggcgtggtggctgccgtggtgtcggactggaccggcattccgctgggcagaatggtgaagaatgagatcgacgcggtgctgaatctggccgataccctgaaccagcgggtcataggccagcgtcacggtctggatctgatcgccagacgggtacgcacctcgcgcgcgcgtcttgataatcccaacaagccggtcggtgtgtttatgttgtgcggcccttccggcgtcggtaaaaccgagaccgcgctggcgctggccgagtcgctgtacggcggcgagcagaacatcatcaccatcaacatgagtgagtttcaggaggcgcacaccgtctcgacgctgaaaggggcaccgccgggctacgtcggctacggcgagggcggcgtgctgaccgaagccgtttcgccgtcgcccctacagcgtggtactgctggatgagattgagaaagcccatccggatgtgcatgaactcttcttccaggtgtttgataaaggctggatggaggatggcgaaggccggcacatcgatttccgcaacaccatcatcattctgacctccaatgtcggcacgcagttaatcagcgcgatgtgtgccgatcctgaactgatgcccgatcccgatgctctgagcaccgcgctgcgtaagccgctgctggaggtgttcccgcctgcgctgttgggccgcctgctggtggtgccttactacccgctcagcgacgcgatgctggcggagattgtgcggctgcagctggcgcgcattgtgcgtcgtctggatgataaccacggcattgaagcgcagatcgacgagtcggtggtgagccagatcgtgcagcgctgcaccgaagtcgagtcgggcggtcgcatggtggatgccatccttaccaacacgctgttgccacagatgagccagatcctgctgagcgcccacgcccgtgatgaacgctatcgccgcgtcgatgtgcgttgtgagcagggtgaatttgtctgccagttcgcggtttaaagcctggctatcagagagtaatcgaatatgtcggaacatgatcaacccctgaatgtccccaacgccttgccgctgggttaccgcttcaatgagtttgaaatcaaagaggtcatcggcggtggcggctttggcatcgtctatcgcgcctgggatcaccagcttgagcgtgatatcgcgatcaaagagtttatgcccgcctcactggcagtgcgcagcgatgatctgaatctggtgctgcgcagcgaacggttcagcaaaacctttcacgccggactaaacagctttattcaggaggcgcgtctgctggcgcgctttaatcatccgaacctgctgcatgtgctgcgtttctgggtgcagaacgacaccgcctacatgggcacggtgttctacagcggcaccacactctcgaacttcagcgaacgtaatccgcagtcggtaaatgaggcctggatccgtcgcatgttgccaccgctgctgggcgcgatcaaaaccatccatgaagcgggttatctgcatcgcgatatctcgctggataacgtccagatccagagcagtggcgagccgatcctgctggacttcgggtcggcgcgtaaaactatcggcaatctgtcggatgagagcgagaccatgctgcgtcccggctatgcgccgattgagcagtacagcgacaacgacgagagcgagcagggcgcgtggaccgatatttacgcgctgggcgcggtgctgcataccctgatcaccggtgcgccaccgccagtcagcgtggtgcgcagcatcgaagataactatcagccgctggtgcagcgtcgtctggcaggctactcgtctgcgctgctgagcgccgtcgatcgcgcgctggcgctgaaaccggaagatcgtccgcagagcattgatgattttgctgtactgatggcgctgccggaacgcgaaccggaaccgctgcttagcgcaaaaatgagcggaccaggcaccatgctggtgccgattgaagaagaagaggaggtgatcaaacccgcctctaaactgaaaacgctgctgggacaccgctttgcactacccggcctggttgccgctggcgtgctggtcggcctgggcgccggtctgctgatgtcacgcggtaacgaacagacaccgctggctgagatcacgcagaaacgacgcgccagccgtcaccgtcgcgccggttaaccagccggttgccgcgcctccgactcagactgaggccccgccggataccgttgccagcactccggctcagacatctgagcccgcgcagaccgccgcgcgtgaacctgatccacaaccggcaccaccacccgctccggtcgcccaggtctatatccgtctgcagcagggtgaacgcgttcaggtgaacggtcagccgcaggcgctggtgccggcggtgaatggcttcgccacgctgcagctggcgccgggcaactacacctttgccatcagcggccagagtggcacccgcgaacaaacgctgaacatcagtgaagaaggtgtctggttgctcgatccacacagttaatagtcagggattacttatgttctcacgcattactgcacagctgccggcggacggcctgctgttccatacgcttaaggggaccgagacgctgtcccgtccgtttgtgctcaccgctgaactgctggccaccgacgcgcgcatcgaccgccacgccctgctggggaagccggtgacgtttacgctgccgaccgacgggctgatgaacgcgctgagcccgcgctacctcaacggcaaaatcacccgggtggcggtgcgcagccaggagctgagcggcacccgctacgcggtctatgcgctgacggtcgagccggacctgtggccgatgaagcgcgaccgcaacctgcgcatcttccagagccagacggtgccgcagattgtgcagacgctgctgaaggagtacggggtcaacgtggagacgcgcctggcgggcagctaccgggtgtgggagtactgcgtgcagtatcaggagagcagcctggactttatcagccgcctgatggagctggaggggatttactacttcttccgccacgaggcggacagacacacgctagtgctgtgcgacgcgccggaccagcatcaggcgtttccgggctatgagaccattgcctatcacgtcaccccgtcgggcggcgtggtgactgaagagggcatcagccagtggtcgctggcggagagcgtgacgccgggcatctacagcaccgacgactacgacttccgcaagccgaacgcctggatgctgcaggcgcggcagaacccggcgtcgccggtaccgggctcggttgacgtttacgactggccgggccattttgtcgaccacagccacggtgagtcctacgcacgcatccgtcaggaagtgtggcaggccgagcaccacagcgtgagcgggtcgggcacggctaccggcatcgcgccgggctttaccttctcgatcatcaacgcgccgcacttcagcgacaacggcgagtatctggtgacctcggcgacctatgacttcgccgagaaacgcctacgccagcggcgacaccggcgacagccgtcacaacatccacttcacggtgctgccgtcgtcagtgacctaccgcacgccgcccgaaacggcgtggccgaaaacgcacggcccgcagacggcgaaggtggtgggacccaaaggcgagtcgatctggaccgaccgctacggccgggtaaaggtgaagtttcactgggaccggctggcgaagggcgatgacaccagctcctgctgggtgcgcgtctccagcgcctgggcgggccagggctttggcggggtgcagatcccgcgagtgaacgacgaagtggtggtggactttatcaacggcgatccggaccgtccaatcatcacaggacgtgtttataacgaggcgagtatgccgccgtgggcgctgccggcggcagcgacgcagatggggtttttgagccggtcgaaggatggtaacagcgatactgctaatgcgttgcgttttgaagacaaagcagggcatgagcagatttggatccacgccgaaaaaaatatggatacggaagtggaaagctgtgagacgcaccatgtcggtgtggatcggcagaaaagcataggccgtgacgaaaaggtcacgataaagcgcaatcgtcaggccgacgtgggtgaacatgcggtgagcaatacgggcatccagcacgttattaatgttggcgaaggcgaaacggtgctgaccatggataaagacggcaatgcgctgcttgaagccaacaccagcattaaattaaaggtgaaagagaattacatcttgatcacccccgacgccattcaaatccaggtgaatacgggaaatatccatgctgagagcgagttgcaggcactgtttaaaggcaataagctgaccaccttaggtaccggtaaagatgctgaattaaaggcaaatgatacggtaagcattaccggcacgaacatcaccgacatcaaaggcgcggtcgtcaatattaacagttaatcgcttattgaaaggaacatcagtatgggtatgcctgcggccagagcttctgtggataaagcggctcacgatggccccattcagtgcggcagtcctgacgttatcattggtggatttcccgccgcccgaaaaggtgatgaattttcgtgtaagcaacacggtggcggtattatcgtcagcggctccggcagcgtattcgttaacggtatggcgctggcccgtcagggtgataagacgcagtgtcatgcaggcggggcgacggctcccgctaaatgtaaacctgcgcccccgcaatactggggaggctcgctggcgaagaaggctggtgaggatgggatgttgcatggcgagcactacgatgcgcgaatcttaggggcgtatgccagcctgaaagacagcaccaatgatggtagttatgacactgtgtcgactgggttttcgcttgaaaatctcacattagcgaatatgaaaagtgacgcccttttgaaaggtgagttgcggaataaaatagcggatgccaatgcaactggctcactttacaccggtgatagcggaatctatggcattaatggcaaagccgcagcggcgggtatgcaatatggcgcgacgggctcaataggaaacagagaacacattgtatgccatcgctaccggcgatgtgacgcttggcactgctgatgcaaaagcggttgcagaagtatataccggcaataaaggaagatatgggttcagcgttgagggtggcgcaggtgcagcggcagtgaaagagagcgttacggggaaagttagcctgtacggtattgtagtagctgatgctaaaggcggagtacatttaggcgcagtaggtgcagcaggaggtttaactgcctatgcggatgaaaccgattactcagctacagtaaagctctcaggtaggttagcttttatactggggataacaggcgaaattaatgtaaaaattgcattaaaacccctccgcgacctgttttttggtgaaagggatagtacagaaaaatctggaagcaatggtggtgcagatggtgctatcatcaacggttgcgcaacggttttagttggcggttaaataaagatagggttgattctaacatgaaatttatagcatttttatttttctggattgtaacggtttattatgtctggaacggaaaggatttttataacaaaaaagaatgggcaggatttggtaagaagtttgtaggtgtgctggttggtattgtagtacttgcctttgcgctcaaaggattagtgttagctattcccggatttagtaatgatcttgctggagatttaatggaagaaataggcatttcttttatatttattcttggcataaagtttatgattatcatgatttgcactttatttagtgggattgtgggttttcaaaaaaaatataatgctgataattatgcccgaatttcacctgctgccagtaagttagtgcctggcatgctcatctttgcaaaatgcgtggtttctcttggctctatagtcatttattacggcatctggctagcgaattaaattaagaagggaaacaggctatgaattttgaaacggactatacttttccccttacgccgggtttctctaaagaagaaatcgaacaacgcttctggaaatgcctttatacatcggccagagaagaaatgctgcattactgggttgtgctgcctaaaagcctcaaacctgtggaaactggagccggttgccttccctgatgtcggtttaaccaatatcggacgctacttaactacggatgactcactctatctggaagtttgggccgcgtatgaacgctgccagtgggagatgaatgcgtctgattggctgtttaaaaaactcgccatgatgggcgaaaaaatcctgcaccgccgtcttgtcggtaaggcctcggaaaacggtatttttgcagatgtattgaccctaaaaacgcacgcttccggtgacgatgtgatctcacgatacactgttcaaaaagattacaatcgggacagcggcggtgggaactacctcttattaaaagcgtcctgcgcagcacgcgactatccttcgcttgccaatgacatctattttacagtggttaactggaatctgctgcaccgcagtaacttagccatggcggagttgctgacctcggtaaacctggatggggaaaacacttttaaaataccgtcttcatggcatgccagcgttattgctgagaacagacttatcgtcgatcacacgataggtggtgtgaattacggggtcattaatttttacttttattccggtaccgtatgccattccgtagaggatgtttttgaaaagtcgacgctacgtttccgggagcatgagcattccgtcacgctggcggcaaacgagttggaacccattcctaatgatattaatgctgcgctgggttcgatatcgacctgtacaggtgaactctacagcgacgaagagaaaatgcgcgccttttaccagagttacatattcaactgttcaggcttgtggtgctacgttgaactggtagggcagcacaggaatgataaaagttatcactttgaagcgaataaacgctgcgtagaaattattctggcgacactgaatatcaacgtgaaataatactgatcctgccaattaatcatcttttgctggcattccgcctcgtagcaatgagtatcatggcacctctttttaactcttcatgtgatccgctgcaacaataaaagacgcttgtctgacccactggtattgcccggtcgcgggtaatacccgggttaattcaccgattaccattagtccgggaaatcactatgtttgatcgtatcaccgtccttctgccggcggacggcctgctgttccatacgcttaagggcaccgagacgctgtcccgtccgtttgtgctcaccgccgaaactgctggccaccgacgcgcgcatcgatcgccacgccctgctggggaagccggtgacgttcacgctgccgaccgacgggctgatgaacgcgctgagcccgcgctaccttaacggcaaaatcacccgggtggcggtgcgcagccaggagctgagcggcacccgctacgcggtctatgagctgacggtcgagccggacctgtggccgatgaagcgcgaccgcaacctgcgcatcttccagagccagacggtgccgcagattgtgcagacgctgctgaaggagtatggggtcaatgtggagacgcgcctggcgggcagctaccgggtgtgggagtactgcgtgcagtatcaggagagcagcctggactttatcagccgcctgatggagctggagggaatttactacttcttccgccacgaggcggacagacacacgctggtgctgtgcgacgcgccggaccagcatcaggcgtttccgggctatgagaccattgcctatcacgtcaccccgtcgggcggcgtggtgactgaagagggcatcagccagtggtcgctggcggagagcgtgacgccgggcatttacagcaccgacgactacgacttccgcaagccgaacgcctggatgctgcaggcccgccagaacccggcgtcgccggtgccaggctcggtggacgtttacgactggccgggccattttgtcgaccacagccacggcgagtcctacgcgcgcatccgtcaggaggtgtggcaggccgagcaccacagcgtcagcgggtcgggcacggccaccggcatcgcgccgggctttaccttctccatcatcaacgcgccgcacttcagcgacaacggcgtgtatctggtgacctcggcgacctatgacttcgccgaaaacagttacgccagcggcgacaccggcgacagccgtcacaacatccacttcacggtgctgccgtcgtcagtgacctaccgcacgccgccggaaacggcgtggccgaaaacacacggcccgcagacggcaaaggtggtgggacccaaaggcgagtcgatctggaccgaccgctacggccgggtaaaggtgaagtttcactgggaccggctggcgaagggcgatgacaccagctcctgctgggtgcgcgtctccagcgcctgggcgggccagggctttggcggggtgcagatcccgcgagtgaacgacgaagtggtggtggactttatcaacggcgatccggaccgtccaatcatcacaggacgtgtttataacgaggcgagtatgccgccgtgggcgctgccggcggcagcgacgcagatggggtttttaagccggtcgaaggatggcacggcggacaccgcgaacgcgttaaggtttgaggataaatcgggtgaggaacatctgtggattcaggcgcagaagaacatggatacccatgttaaaaatgacgccagccattcagtcgccaacaatcacagccattacgcgggcggcaatgagctctaccgtgtcgaaaccaaccgtgtccacggtgtaaaagggggcgaagagcggctgaccggtaagagcaaactcgatgcggtggtcgatacctatgtagtgggtttcgggaactaaacttcgccttgagtgcggagagagtgctatcgaactgaatgcgaatggccagattaatattgtgggcaagggcttcaatatttttgtgcagggtgatggtcatatcaccacctctggcggcaaactgaacctgaacacggatggcgcgaagccgggcacaagcgcaccgggctccagccataaacagaacatcagccaggccgtagagaatctgttcccgccgaagcagaaaggacaggcggctccggctgcgccaaaagctgcggcggcaccggcgaaaggggcggctgcgccgttaaaacaaaccgctaattcggatgacgctaagaaacttgatgacagtgttgttcgatcaattatgaagtcagaaggagcgggtggtgaacagggcggtgttccggaaatgtacggtttcagaaaaggatttgggcctgcatataaagatatcgcagccgccaggaagaagtatggtcaggggagtgatgaagaatttgaggtggtgtcaaaatatatgaaccagacagcccaaaaagccggggcgcttaattttagtgatccaggaaaacaagcagccgttatgtcattagcacacatgagaggagtgggaggtgctcaggctatactcaattctatgagtggtgatgatatcgtcaaatcttcacaactcactgaaaaatctattgactatgttgaaaaaatgggttcttctgaattccaaaatgaccttgtcagcgccagattgaattatgacaaggctatatatggttcaaccactacggtgaaaaatggtgtttcatataactggtgggatcattattcaaccggtttgactaagcgctataccaatgaagctgctgaatttttgaagttttcaggtgaatgaaatgaatctatttattaagttattttttctggtcttttttacaggtggttcaataggtgttgcaacagcatcggatacccagacggcttattctcagtataataacctgaatagtgtttcagctatttttaatgaccagaaagtcgtttccagtttaaaatctgttttaggcagcgagtacagtgactttagccagaattttgatgtatttggcgagcctcacaaaacagctaaggggggtatatttgtcgagggctggttaaaagatctttatcttgagcaggcttcagcatttgttatacagcctgacggtaaagtgtatgctgcatggatgctgcctgaagataataaaatacattatgtaagcaatgatcttgcaaataataaaatgcaggaagatattgcgagttgggcaaagcgttttgataaagaacagtcagttactcctgctaaaaaccaaaaagaaatgcaaagcaatggcgagaaagttttcgagacggaaaaattcaaaatcagaataacgtcgctttgccctgtgggtttcggagtgtaatgacgttagttatgagggtgtaaggaaatcagatggggcagttgtcagattaaaaggcaaagccatgaaaagtgattgtggtcaagcatcctgcccggtgttgagttataaattccgtaatcatgatgcaacctatattatcaataatgtaattagtaatcttactgttgttgttaataataaaatcgtactatctgaagacggaaaatggaagagtgattccgagtaattaaatttctgtgtgatggtgtgctaattttacgcactatcacacacgatttttgcacatcatatataaatggatttttaaagtggcagatcttaaatataatttatttttcgattaggtgtgctgctgtctgttatttttttatgctcattgtgtaatggcggattatttcactactgaactaaatgcctctgactttcgtgtaattattaatcatcattgttttgctttaggtgaagattgtagcagttaaactcagaagcaggcgggcacgcagataagtgaaaactttgacaatgacaataacctaatctgtgaaaagcgtgatgacaactcgctcagtcaggcgctgtaactctaaatttacctaatcttaacggctggattaatagggttaatgattgtctggattttaaaggttaatcaaatgaataaagttggatttagcttagcggttttgttgtcaatttcttcattatccttgtttgcttctgataattttactggtcagtggagtgggcaagagaaaaatgataatggatcactatattccactctaacattaaaattaaaacagaataataataacataacgggtagttattgttatgtgacaaggggcggaaataaaatagattgccctgatgataatgacagcaatctcaaaggtacggcaaacggtaaaaatgctttgattgaatttgattcttcatttggcggagtgaagggtaaagcaaatttagaacttaaagataataaagttttatggaagttaatcaaagaccctgagaatggggatttttatgcgccaaaaacttataatcttgacaaagatgttagtgaaggagatttaaaatcagatatgaaggttttgtctacatctgatttcacgattactttattgaatagctgtgggggtttttatactgtgtgtgataaggttaaatacataggcctcagaaataaagatggaaaacaaattactcttgaaggtaaaactacgcagcctgtaaactcaaataaagctgaagggatgattttcaataatagcggtgtagattatgttgtgagctttaatccgcttgaattgaaggtggtacagggtaataaaacgcttgttaagcaaggtggcaagtgggaatgataattttcattatcactcaagtgagatttttactgtatttcaagtaataagaatgacattataatagtgttatgggttttattagggtggtgatatgtactctccaccccacataattttgaagtgtgagtaatttctttaatttaaaagattttaattacgttgctcttagtgattaaatacccttctatttttctattgtcaacccccgataaaaacacaatgattgtaaaccgttatttcgccagcattgtatttgtgcctgtcctcatggttttatcctgcattgccagggccgaatccagcacggaatcgaccgttcctgcccttaacgagggcgatttttccgttctgctaaacgactatgctttcactcccggagacacatggagcaatgaaagcttcgtacgggctggtaaggctctgagttcagttctggccggagaagtggctatcaataaccagcagtacaactacttccagcatagctatgacggctttgagttgttcagcgcggcggcggttggagatgccagccacacggtttctggctgagatccttctggaaaatgccaatgtgccgacgtcccgaaatataaaggtaggcgatagccttgaacaggttcagcaagcctatggacccggaaaagaagataacagtgatgatcagcactggcttgtctacccgtctggcgggaaacagttgatgttccagattgaccagggaaaggtcagctgcatcatgttgaaaacagacatgggtgcagagcaaagcgaaatcagcgctgaccaggctatcagcgctgcaaccgaagcaattcatacctggcacctgaccaccctcgacgagaaatgcctgcgatacgatcttgacgacagcagtgatgaaagtttctttattattacggttcgtgaagataatcacgacgccagttgcggtggcgatcctgatattacgcatcgacttttcgacattaaagttgcgcgtgataatacacagatactcactaatgccgataacgttgatggcgaataccatagcctgattccacccgccacaaacaattaataaaacggatacccaatatgcattaccaattcaatgagggcgcctttgcgctttttcctgctgcctggcaggacaccaccatgaatattctccgcgatgaagccagtgggctggcctgggttgtgagccgtggcgttatttctgagggcagtgatgcggaaaaagagtttcagcgtcagtgggacacattgcggagtcagatgggccatatccagcaggctgagtttgtacgtttgatggcaggtgtagataacacattacacgcggtagaagttgaaaccgtatttgaccgtaacgggcaggcagtgtggcagaaacagctggctacacaggtgcctgaatcgaacatcttaatgatttttacgctctcagccatgcgtccattcaatgaagaggatggacagcgctggagtgcatttaaacaaagcctgagtctgaacaatccacggaaagcataacctatggataaccctgctgcccgcgtgggcgacgagatcattcactccagcattttcgctgatatcacaagcattgttgcggaaggtgcggcctatgccgtcattggtgccgcagtgggtgctgctatcgtctcggcagcgcccctgctgggcacaggggcggcagcggcgagtgtggcagccgtgggtaacagttgcctgctcagcggtattctgggtggtgtactggccaatgccgttggtctgtcacaagagatcagcaaagcggccgatgggctgggaaacatgatattcccgccgtcacctgccggagtaatcgccagtggatcagtgaatgtctacgttaatggtcttttagccgcacgcgcggccgggatgctcacgcctggcgagacaccgccaccggaaccgcaatcgccgcagagcttcgcggactatggcggcatgttgctctctgcggtcggccagtttggcagtgcaatgtggcagcccacggtagcctccgccgatgcgggcacctctccgctggagcaggacaaagtggcctgtgaaaaacacagcgcaccgcaatatctggctcagggatcgaaaagcgtctttatcaatggccagcctgcagtgcgcgcaaaggataaaaccacctgtgacgccaccgtgagcgacgatgtttcccccaatgtcatcattggtggtgaaactgtcacggtcagagagatcaaaagtggcaaggtgccaggtctggccgtgatgatgatcggcctttccctcatccgtggtcgccccagtcagatcatcaaaaacatgccctgcgcgctggccggtgccgtgggcggtatggcggcggacatggctatcaatgcggccttctcgtcgctgtttccggttcatgcggcgaccggcgtcaaagtccttaatgatgatgccgagcgcgatttttcccttcccggacgtttcccgctcagttttcagcgcagctttaacagccttacccagcgcgctgggctgtttggtcagggctgggccacggtgtttgacagctacctgacgctggaagggaatcgggcgacctggtttgatgacaacgggcgcgaaactgagctttgacgttcccggtgacaaagaggtgctctacagcatcagcgaagggctgatggtgcggcgcaacgagtctggcgatatcgccattgccgatgatgacggtgcggtatggcgtctttacaggcgcacggccgctgatccgcaggtgctgcggctggcttcactgagcgacgagtacggtaatgcgctggagatgggctgggatgaacaggcccgcctgttgcgtatccatgacgcgccgctggcgattgacgtcacgctgcactacgacgacaaacagcacgcgcggcgcccgacatcagccagccattttgatggcgatcagcactggcctctcacgcgatggacctacaatgatcggggccagcttaccagcgttactgatgccgcaggcgttgtctcacgacgcttccgttacaacgacgatggattgatggtctggcaccaactgccgggcgggctggagagtgaatatcgctggcagaagctggatcactggcgcgttatagaaaaccgcaccaacagcggtgatggctgccacatgcattacgatcttgaggcgggcatcacgcgcgtgtcgacctatgacggtcagcagcgcgaacaccactggaatgccgcgggcctcatcacctgttttatcgacgagcgcggcgagaagtggcgctacgagtgggatgaaaacgaactcctgacgcgtcgcatcgatccgctgggcaacgcggtgagcttcacctatgacgatctgggcaaccgtgttgaagagaaggatgctgacggtggtgtgcaggcggtgcaatggctgtcacaccgttcgttgcccacggttgttgccggagcagacggttccacaacgaaatactattacgatccccatcacggccttgaacgcgttgttgatgcgctcgggcaaagcacgctgtataagcgggatgagttcggactggttgtcgaagagactgacgcagcaggtaatagctaccgccgtgagtttaatgatgccggccaggttatccgtgaaaccgactgttcagggctgaccacgcgctaccgttaccatcccctgggctggctcagctgtgtcatcgcgccggatggtgaagaaacccgttatcactatgatgcagcaggccgtcctcttcagctggaacgcgcagaaggatgggaagagcggttgcactggagtgaaaacggactgccgctggcctatgaatcggctgatggcaagcgcagtgaattccgttacgacaatgtcgggcgattgatcgccaaccgtaatgcgcagggtgagacggttcagcgaagctgggacagccgtggccggttgacggcgctgcaaaacgagaacggcgagcagtatcagttcgagtggggcgcagattctctgttgctggcccaggtcgggctggatggtgttgccacgcgatatgactatgatgcggcgggccgcacggtatcacgcacctttgccgccggacatcctcagtccattacccatcgctatcactggagccgtgcggggcaactgctggcgcggaccacgccggaaggccagacgcgctatcactacagcggtggggggcaactgggcaaagtgtcgcagcatttgccgctgtctgacaccgagtggagccagcaggccgagcaggagattaactttaagtacgatgcgctgggccgcatcgttgctgagcagggggagcagggcgaactggcgtgggagtatgacgcgctgggcaactgcactgccctgacgctgccggatggccgcaacctgaagcaactttattatggtagcggccatttactgagcatcgcattagacaacctgccggtcacggaatttacccgtgacacgctgcatcgggagctgagccggacgcagggcggcctgaccatgcgcagtgagtatgatcgcttaggcagactgcgccgccgtgacgtgtttaagggtgactcacagcgacctgcaccgcgcgtctggtcccgccggcgcgacttcgattacggcaacaacctgattcgtgaagagcgcgacgataatccgttcagccagacattatggaactacgataacgccggccggctgttgtcacaggacggtgcgcagccgggtaatgaacagtggcgctgggatagcgcaggcaacccgctggatcgccatagtgccgctcatgtcatgcataaccgcgtcaccgaactgaacggtatccgctggcagtacgatattcatggccgtaccactgagaaagatgacggtcacacccgctggcgctaccgttacgatggtgagcatcgcctgacggatgtgatcagcgagccgcgggaccgcaataagccgcgcactaaggtgagtttccgctacgatccgctgggacgccgcatcagtaaaaccagccagcagctgttgcagggaagaccgtcggggaaacgccgtcacgacgcgctttgtgtgggaaggctaccgcctgctgcaggaaatccacgacgggatcccgctgacctacgtttacagcgacagccagagctatgagccgctggcccgtattgatggtgttgaaagcccggagatttactggttccataatgcggccaacggaatgccggagctgctgactgacggtgaagggcaaaaagcctgggaaggcattaacagcccgtggggcaagctgctgcgcgagtccagccagcgtgttcctgtggtggagcagaacctgcgtatgcagggccagtacctggaccgggaaaccggactgcactacaatctgtttcgttattatgatccggacagcggacggtttacccagcaggatccgatagggctgggaggcgggatcaacctttaccagtatgccccgaacgcgctggggtgggtggatccgtgggggttgatgaagtgtaaaaaccctgcgaaagaagcaacgaagtggcagggaccagggaataaaacttatccaggcatcgatgtttatgagaatacggttataaaaaaagggacgatactttatgctcttcatcctaatggagatcagttacctgcttatactgtaagtcatcctacagtcagacaacataaaggtgatccacttggctaccatgaagctttgcaagttgagttgaacccagcatatccaatgcgttcaaaggtgagagcttattacgttacagaagatatatttgtagccagagggcgtgctgaagccaatcctaaacatggagaagggggagggctgcagttctatataccggaagaagctcggcttaaactgaaacctggaaaagtaattgacatatgaaaataatgaatttagacgagtcaaatggagctttacatattgatgggagtgaaatagatctttcatcttacgaggcttttactaagtccttgttttttaattcagttgatgagctgaaaccaattggaaaatatcgttttttttcaaaggacgtcagttggcacgatgaaccatttactgtggaattcaatccggctgttttttcttttaaagcgctagttttcctcaccagtaaaacaggtgatttttataaaagtctatctgattgggaaaaaagagccaatgtaaaggctttaaaggaggaagaaaaaagaatgtttgaatggatgctaaatagatatcctaataattataagggtgaattaaaggaacctccttatggtcatgtttggagttttgaatggggggagataactgtacagtcggaagagaaatcatttaattgtgggatatatattgagtggaattaatttaaattatcagtcctattgagacgttatttgataatgttggtgcaataacatattaacaagattccaacgtttacaagttagtcgttgataatgaatacggatgtcagatagcagtttggttttagtttccgtaatgctggcaggaatgataaatagacccgctggcgatattttcattatgataaggatttcctgatgaatgttatttcagatggtaagtaatctgttataatatttttctgatgggatttatggctgctgttggatgtcattattgcagtgttgataaatagaataactggcacttttcattcaatcagaaaatgataagcttgttcgtggattgcataattactgatatataatcctggtgcaataatgaggggttttctcttcgaatttaatatctaaacaactctattttatcattgagcctataaggagataaaatgaacctgccaggaatgaatcctgaaaataacttaccgggttatgacatcgcgaggatgaccggttatggggcacctgattttgatttcaaagcgctgggtgcagcaatggattgtactcgggagttttatcaggctggcatcatctatgcggatggcgcacagcgttatcttgtttcggcctggtcagcgtcatcctaatggtcaaagtggtatcgttacacatctgattgtgaccaaaacgcctaagcaagccacagcgtctaatacgggcaagtcacttagtgaagcagtaagcgtaacctcaatgggaacggagattgcctcgaccgtgctttcctgtggtgcaatgattatcactgctggcgtagcggttatcggcgcttctgcaacgcctataaccgctggcagtagcggcgtgcttgttgctattggttatgctggcgctgccgcaacaggcgtgcaatgtgtcaatggtatttaccgggtttatgatctcgtcgaaaatggtggtgaaaacgtagcgtggctggactctcaggattggtacgttgccacttcaacgtctcttgaccttatttcactagccagtgtgggcggtgcgttaaaagaagcccttgcaacatggcgagcgatgaaatcagtctcttctttaaaagcaacggagtggctccggaactatccaaggcaggaccgggctcgccttactgaattaatcattaaggcacaaaaccctggtataagtaataaagagcttaaagccgccatccgtgcaggactttatccaaagcgtttccctgtagagtcggtgcaaaaagaacttgttaagcaactcgcgcaggtcgttacgagcgcagctgctgtggcaggcagtgctgtcagtggtatcattgctgctccaggtaatgtgccacgctccgggcgctatattgtgggaacaattcaatcactggcggtattttaatgcaatttctatcatggcttgtcgggcgaaatatcactgaactactgcaacatggtcgcgaaatagatcagctaatcgcacggcaggataattcgatacttgcccgttccactacagagcttgaacgttattttaaacagcctgctgagtcgcttcccaggcaaaacggcttcccggttgcgatagtgctgatgctgttgctggtttcatttgcatttaatttgctgacgtttctgcacgctttacctccgctcagtccacagatacatgcgttgagtttttttgttccctcaatcgtcgttattggcgcgatactcacggccagttacctgcttgcgcgaggccatacagccggtgtggcggggctggcttacgtctgtgcgatgttgtttatatcgaccgttttactcttgagctacagcgtagttacgggtagccactcgggtctgtggctgcttctggcactcgcggctttggtgggggctcgctggatacttaacgggcaggctttcatcctttttgccatttactgccggacacaacgcctcgccagcgtcgcccggcagcgtcgcatgaaataacccatactgatctgtagtactgttatcgcggaatacccattccgcgactctcttctatttttctctcaacacgatctttttcctatgacccactccttcttttactccatcccctgtcccaaacccccctgaaaaacccatccatcatcactattacctctggctataacctgccgttataccctcctgctaaacaagcattcgtcacctttcagagcgcatgaaatagtggtttcagaacctgatcttttggctgaaacgagagacaacatgctaatcccacaaccctatttactctttcttggcgatgttaccgatccccttgcggcaaaaacggcgcgcggtattcatatctggcggccggagcagtgcgttggcgaaattaaactgtcgggctgcacggtcagtctgggtctggatgaactggatattcccggcgccaaagcgcgcggagcgaaaacgctggtgcttggcactgccaatgccgggggctatctgccagatcactggctggaaacgatcaaaagtgccattaaagcaggcatgaatgtggccagtgggctgcaccaccgactggtagacgaaccggaaactggtgacgcttgcacaggcttcgggtgttgaactttttgacctgcgtcatatgcgtccagtgctcagtgtaggcagcggcaggaagcgttcaggtaagcggatactgacggtgggtacagactgctcagtgggcaagatgtacacctcactggcgctggaagcggcgatgcgtgcgcgtggcctgaaagccgattttcgtgccacggggcagaccggcattctggtcgcaggggagggcattgctgtggatgcggtcatcgctgattttattgccggtgcagcagaggcgctgtcaccggcgaatgacgaggaccactgggacatcgttgaaggccagggctcactgttccatccctcctatgcgggcgtgagtatggggctgatgcacggtgcgcaaccacactggctggttatgtgccatgaaatgggacgacctcatatgcgtcatttgccacaccagcccatggtcagcctgcaggcgtgcgttgaagccaatctgcgtgccgcgcaggtgaccagtgagtcggttcagctggctggctttgctatcaacacctccaattacagtgaagaagaggcgctcgcttattgcgccgaaatcagcgctgagtttggcttaccggccacagatccggtgcgttttggtattgatgagatcgccgcactgcttcaggagcgtggctgaaatgagaaagttgcagattgatgtggtggagttgccgctggcgcgaccctttgctatcgcacgcggtacccgtaccgccgtgacggtcatccgtgtcacgctggagcaggagggattcatcgggcagggcgaatgtacaccaacggctcgctacgatgagacgccggatagcgttaaggccatgctcgaagcggtacgcactgacattgagtcgggcctcagccgtcatgatctgcaacaccgcttacccgccgcttcagcgcgcaacgtgctggactgtgcgctatggcgacttgatgccgcacgggctaatcaaacgctttggcaaaagagcacctgctctcagcctgagtcagtcattacggcagaaacccttagcctggatacgcaggaaaatatggctctcgcagcggcggatgccgtgtcacgaggcgccatcctgctcaaaattaagctcgaccgcagtgaaattctggaaaaagtggcggcgattcgcgcggcggcaccccatgccacgctcattatcgatgccaatgaagcctgggcgggtctggaactggaaagcctgctggtggcgcttaaggcattcaacatcgcgatggtggagcaaccccttcccgccggacaggaccatgacctgttacgttttaaacatcccataccggtctgtgccgatgagagctgccatacgcgggcggatattgccggattacgcgatcgctacgagatgatcaacatcaagctggataagtgcggtggcctgacagaagcgctggcgatggtggatgaagcccggacgctcaatatgcgcattatggtcggttgcatgctgggctcgtcactggccatggaggccgcattgcccgtcgcggttaacgctgagttcgtcgatctggatggccccatctggctagccgccgacagttctcctttcctgagctactcccaaggccgtatctggctataactctgtgaggcgacgatgacggacacacaacgtacttcccctgcaacccgcgctgcctctgtctctcccgtgctggcgattcaggatctcagcgtctcgtttcatggacgcagcggtgagaatcaggcactcaaaggcatcagttttgccattcatccaggtgaaatcgtcgccgtcgtgggtgaaagcggctcaggtaaatctgtcacgtcgctggctgtgatgggcttgctggcaaacaacggacgtgtcgatggcggcagcatgcagtttccgcgaccgcagcggaaaaatgcatgcgttagaaaagctggatgacgctcagcgccgcacgttgcgtggccgtgaaatggcgatgatctttcaggagcccatgacctcgctgaatccggtgctgcgtattgatgatcaacttaccgaggcattacgcgatcatcaacagtgcgacagaaagcaggcccatgcgcgggtgcgtgaattgctgcgacaggtgcgtatcgccgatgtggatcgcgtcatgaaaagctatccgcactcgctgtcaggcggcatgcggcagcgtgtgatgattgcgcaggcccttgcctgtgacccacaactcctgattgccgacgagcctaccacagcgctggatgtcaccgtacaggcgcgcattctccatattctgcgtgagctgcaacgcgagaaacaaatggcggtgctgtttattactcatgatatgggcgtggtagcggaaatcgccgatcgcgtggtggtcatgctgcgtggcgaagtggtagagcagggaaccgtgtctgagatttttgccgccccgcagcatgcgtataccaaagcgttactggcggcagtaccaaaactcggtgatatgcgggaacacacatggccgcaacgctttcctctgcccggtgcccgcgagactgtgcaaggcgaacagcataccgctcgctatgacgttgcgccgctgctggatgtgcgcggattaaaagtctattacccgattcgcagcggcatcttatcgagcctgacgcatcacgtgcatgcggttgagcagattgattttagtctgtggccaggtgaaaccctggccatcgtgggtgaaagcggctgcggcaaatcgacaaccggacgggcgctgatgcgcctcatcaacagtgaagctgaaagtattcactttgaaggaaaggaaatttctgacctgaaagaggcagaattccagccgctccgccgtgaaattcagatggtgtttcaggatccctatgcgtcactgaatccccgcctgacagtgggtttcaccattgccgagccgttgctgttacatggcatggtctcttcgcttgaacaggcttccccacagatcgatgcgctgctcaagagcgtcggtctcctgccagagcacgcgcgtcgttatccgcacgaattttctggcggtcagcgtcagcgtattgctattgcccgcgccatggcgctgaaaccgaaagtgattattgctgatgaagcggtatcggcccttgatgtctcaattcaggcgcaggtggtcaatctgatgatggacctgcagcagcaaacgggcgtggcatggattttcatctctcacgatatggcggtcgtcgagcgtattgctaatcgcgtcgcggtgatgtacctcggccagattgtggagcttggaccgcgccagtcggtatttaatcagccgcaacacccctatacccaacgactgctggcctccgtgccggtagcggattccgaaaaccgtcagccccgtattttcgatgacagcgaaatcccctcgccgttgcgtaaggtgggtgaaacggtcactaaaactcgatatcggcaggttgccccccagcactgggtagctgacggcattgcattgcaataatccttaacgaccaggagaatttatgaaaacgctgtttcgccgtacttcgctcgccctcgcattgacgacgacgctggtcatgactgcgcaggcacaggatctgcgcatttcaatgtatgccgatatcacggggctggatccgcacgacacctcggataatgtcagctactcggttcagagcggcatctttgagcgcctgttccagtttgattcccggatgaagctgcaaccctggctggcgaccggttatacctctaatgacagtgccaccgaatttacgctgacgctgcgcaaaggcgttaccttccaggacggtaccccttttgatgcagacgccgtcaaagcgaaccttgatcgtctggcagatcagaaaaaagggctgaagcgtaacagcctctacaaaatgattgataaggtcacggtgctggcacccgaccaggtaaaaatcgatttgaatcagtcgttcggggcctttatcaacaccctggcgcatccttccgcggtgatgtggagtccgtcaattcttaagcaatatccggacgaagcgcagttgcgactgcatccggtgggaaccggtccgtttacctttgtcgactggaaaccaggcaaagccgttacgctggccagatatgcaggttactggcagcagggatggcctaaagtcgaccatgtcatcttctcgccgagtcccgaagatgcgacacgggtggcagcgttgaaatcgggccaggtggacgccatctggccattgccttcagacctcatcgcagccgttcagcaggacagccacctctccattcagcgcgatccgagcatttacctttattacatggcgatcaacacgcagcacaagccgctggccgatgttcgggtgcgtcaggcgatcaactatgcgattgaccgtaatctgtggctgaaagtggcctttgccggtctgggcaaacctgccacatccgcgatcccggaaggcgtacagttctatcagaaacagaacgatcctgattacggctatgcgccggataaggccaaagccttgctgaaagcggcgggttatccggagggactggatcttaagctctgggtgaccaacgccacggcgagcgtccgtgccgctcaggtgctgaaagcgcaactggccacggcaggcatacgtgtcacggtaacaccgatggattccggcacgcgcaacgctaagttgtggggcgttcaggacccgaaaaaggcggagtttgacctctattatggcggctggtcgacctctacaggggatgccgactgggcgctgcgtccgctgtttgccaccgagtcctgggttccgacctcgtataacgtctcctacttcagtaacgctgatgcagacaaagcgattgctgccgggctggcgacggccgatccggcaaagcggggcatcgcctatgcacaagcgcaaaaggtgttgtggaaagaagcaccggtggcgtttccttggcacgccagacaatctggtcggcaaacgcaacacgctgagcggcgtttcgatgctgcctgatggcaatttactgttcactcaggcgtcctttaaataagacggtctcttcttcctcgtcccctgtccggaacggatgagggacgcgaggaggccagtcgcacctcatttcagggaatggcatgtttgcatacatcattcgccgattgctggagatgatcccggttttgctggtggtctcgttgctggttttcggttttatcaagctcatgccgggcgacccggcgcgtatttatgccggaccggatgcgccagttgaggcgatcgaagcggcgcgtcagcatctcgggcttaacgatccgctgccgcagcagtattttcactggatcggcaacctgctgcagggcgacctgggcaccacttatcgtacccagcaaccggtgctggaggtgatcaaagagggctttatgccgacgctgtggctcgccttagcgggttttacctggtccgtcattctcggtttgttattcggcgttatggcggcactgaaacgtggaagatggcaggactggacgctgatgagcgtggcggtcggcggcatttcgatgccagccttctggctggggctgttgctcatccagttcgtcgcgatgccttttgggctgttctcggttagcggctttaacagggccagcgatatagtcctgcccgccatcacgctgggttcgtcggttgcggcggtaatggcgcgctttacccgttcggcctttcttgaggtggcgcaggaagattacgtgcgtaccgccaaagccaaagggctgcgtaaccgcctggtgacgtggaaacatgtgatgcgtaatgcgctcatcccggtgattaccatgctgggcttgcagttcggttttctgctgggcggatccatcgtggtggagagtgttttcaactggccagggttaggctggttattgattgagtcgatcaaagcgcaggatcagccggtgattcaggcgctggtgatgctgttcgtgtttgaatttattgtgattaatctgctggtcgatctgctttacgcggtggttaatccggccattcgtctgcgacaggagccaacatgagtattcaatcgctgactgaaaatctgcctcagattattcgttcgccgtggcgcgatttcctgcatgctcttgtgcgtaaccctctggcgctggtctcaggcgggtttgtgctgctgttgattgtggtggcgatttttgcgccctggctggcgccctgggatcccatggctccggactggatggcgttatcgtcgccgccaacggcggcacactggatggggaccgacgaactggggcgcgacctgctcagccgcattatctatggtgcgcggatctcgctctatatcggcgtgctgtcggtgacgatcggcatgctggtcggggtcatgctgggcttactggcgggctattacggcggttgggtcgatatgctgatcatgcgcggtgccgacgtattattcgcgtttcccggcatgttgctggccattgcggtggtggcgctgctggggacgggtctgaacaatgtcattatcgcagtcgcggtattcagcgtgccggtatttgcccgcatcgtgcgggcttcgacgctctctctgaaacaggctgcctatgttgaagccgtgcgctgtgccggtgcaccagacagagtcattatcctgcggcatattctgcccggcacgctttccagcgtgattgtctatttcactatgcgcattggcaccagtattctgacagccgcgggcctgagttttatcggactgggtccggagcctgacgtgcctgaatggggcaatattctggcgatgagccgaagcatgatgatggccggatcgtggcacatgagcgtatttccggggctggcgatctttattaccgtgctggcttttaatctgcttggggatgcgctgcgcgacacgctcgatccaaaactcaagggctgactatggatttccaacaattgcagcgcgatttgctgctgaaacgctggcgtgatctgcgtcagctcgggcagccgcgaagcgcctgcggacccaccaatcgaatcagcgatgttgcgggcgtgcgtgtcggacattgcacgctgaatgaaggcgaaaagcagactggcgtaaccgctatcgtaccgtcgggcggcaatctgtttctcacgccgctgccgtgtggggtggaggtcctgaacggctttgcgaaacccatcggactggttcagatagaggagcttggcgtgcttcagacgccgattttgctcagtaacacgctggcggtcggcacgctgtttaccacgctggtgcgggatgccatccgtcgtaacccggaactgggacgaacactgcccacggtcaatccgctggtgctggagtgcaacgatggctggctgaatgatatccaggcgctggccatcactgaagcgatggcgcaggaggcattgcagacggcctcagcggacttcgcgcgcggcagcgtcggcgcggggcgcggtatgagctgtttcagcctgaaagggggaatcggaaccgcctcgcgggtgattccctcgctcaacgccacgcttggcgtgctggtgctggccaatttcggcgcactggaagcattaacgcttgatggcgttcgggctggcgagatgattgcgccgctgctggccggggagacgccgcagctggatgccggttctgtcatcatcatcatggcgacggatgcaccgctggacgcacgtcagttaaagcgcatcgcgaagcgagccggtgccggcctgggacggctgggcagttactggggccacggctcaggcgacattgcagtggcgttttcaacgcaacctctgccgcaaccgccacaggacgacacgctggagccgctgcttgctgcagcggcagatgcaactgaacaggctgtactggatgctttgctgagcgctgaggctgttaccggctttcgcggtcatcatcgcccctcactgatgcagattctggatagattaacgacatgaaaatttttatctcggccgacattgaaggcatcgcgggtgtcatgcgcccggagcaatgtacacccggccacccggaacatcagctggcccgtggtctgatggagcaggaagtgaatgctgcgattgagggggcttttgcaggtggggcaacggaagtggtggtggcagacagccatgcgcagatgaccaatttgcgtgcggaaaatatcgatccccgcgcccggctggtgcagggaaaaccccgtgtcctgtcgatggtggaagggatagagcagcagacgttcgacgggctgtttctggtgggatttcacagcgcagcaggtgaacccggcgtactggcgcataccatcaacggccgggcattctggcgtatccatatcaatggtctggtgatgggcgaaaccgatatttatgcggccgccgctgctgagcacggcacgccattgctgctggtcaccggcgacgatcagttacagagctggattgcggaacactactcagcagttaattacatctgtgtaaaacgcgccatttctcatacctgcgcggaatcaatcagcccacaagcggcacagcgtgcgatcgctgccgcagcaagcgccgcactgcaacatccccctcaggtgagcacgagccgcctgacggcaccttacgctatgcgccttcaggccactaaaccggtgctggccgatctgttcagcctgatccccggcgtcacgcgcctggatgccgttaccgtggcgtatcaggcggagaatatggagacgttaatcagcttactcagtgcattctcctatctggcgagcacacagtcatagcgaaattatcccgggctgcatgcaacgtcagcccgttaagcccgcctttactgttctcctgaaaccacgctgccaggcacacgcctgtagtgcgggctgtgcatgcgcatcctccctctggcgagtctggcttaaatccgctcaacccacgctgctgaccagcgctcctttaactgcaccacggcagcgcgagacccgctccctgcagaggcttcagtcgggactaccgggtgcggataggagcgagacaggcaactgagcctgcaccggttttgcggtacagtttttgcaacaggataatgattgctctctcaccctccgcctgcacctgcacctgatcgtacagcctgtcggagaggccttcgttttcggtattccatccagggtaaatagtcatgcggctccgccatatagaggtctttcaggccatcgtacagaccggcagcatcagcgctgcggcgcgcttgctcaatgtttcacagccgaatatcagccgtgtgctgaatcatgctgagcagcaattgggatttgcgctgtttgagcgacgtatacagggaatgagtgtgacggcagaaggacgacgtctgctgcctgaaatagacgatctctgccagcgcctgcaatccatcacccagcttaccgaacagctgcggcggggcgaagggcagctagtttcgcgtcggcgcggctcacgcttttggtcagatggttttggcgcccgcattggtcacctggcggcaacagatggcctcggtcagtgtcgaactggtcaccgagcactttagtaccttatgccagatgattctggataatcagctcgatttcgcgctggtttttggtcagcaggtcgatgcggatcttctggctgaacctctgtttcagtcttcgatggtcgcgctgttaccgctcaatcacccccgtaatgaacccgttacgcttgcgtggttatgcaacaataatttactgatgatgcaggctcaggatccgcttggacgcgtacttcaccgagcgctgcgcgataaaaaactgaatcccgccgtgtcgttgtcgattaaaacctattcggtcattgcggatatggtgctggcaggcggcggcacgggcgtcgtggatctcttcaccgcctgtcgctatgccgaacagctaaagctgctgccgatagcacagcccctgccgtttgaagtgatgctgatcagccgccgtgaccagccacagtcgcagtccactctgcagcttaagcaggtgatccgtaacagactgtgggagatcgcccggcagtgcgaagcgcagtttattcggggctgaagtaagtgccgtgcttcaccgctacccatccggctattttgtgagatgcatcacaaaatttttagaatttcttcctgatttgaaaccaggctcgctcgcgcatcactcaaccctgacgctgcggggtgagttgctcatttcgcaagttatcaactgaccggttagtgataaccggtacaacctggcggagtgagaattatggatggaattagacgcacaccttcccctgtgcatcacgaaacgattgaaatgcccacgcgcggtgggccatcaacaactgaagtcactgctacaacccctgctgcgagggctcgtttctgcggagattagccgtattacagctactctgcataacgcgtgtaaaggcggagagaacgtgcgtgattacctggcaggaatcgctgtcaccctgcacgatgaattgcaccagacggacgatcaggtaaaagatgtcatcaaactggctcacagctgcgacacgatgatcatggccaaggcaaagggggcgattggaatgacctatgccctttccggtgtacctggcgatctggtcggcaaggggatagctagcgcaatgaagctggagccgggcacgcccatgcacaactttgtcgctggcgtagcgggggggatgactgcagtggcttttaaagcggtgctcactcgggttatcggtagcagcatccaggattcgagatggatgcaggcagatatggatgcactggagcctcttatgaaagatgaggcagaaaaacgcgagacatttgggcataaattaaaaatgacggcgctgggcgggacgggctttaacgtccgcaacccggtgacgggtggaatttccagtgcaacccagctattacccgaaaataagccgcggccagaaccgatggggattatacagggtgcgctcaagccgggttatgccatcaaccagatagcaggttttggcctgacttccgctgccggtgcattgagtggagttgtggaaaactactacgacaacctgcacggcgcggagtttttatttggccgtaacgactggaaggatcgttatatgtcgctgtccagcgggcacacgaatagtggcgaggggagccacttcgatgcggtgtgggaacacgccaaagcgccaaaacgttgggttgaaggtgttacaacgctgagtgcattaagtgcggtagcctctgagacgatggaagcgctcggtttgggcatcggagcgggggcggcacgtgtgaccaaaggtggtgcagagaagcttttcacctccggcaagacaagtgcggcagagaccgctttggatctggcgaacaaatccggcttccgcgtttcccgcgaaagtgttggcaatgcggcggccctggtgccaaacgcctattcttacctgcaacagggggtgttcggtcttctttatcaggaggctgagcgagcagtggcaaacaagctgcacccgaagcccgccgacgcgacagaagaggaagccccggtgagttcaggggcgagaacacctgaaggcgcgccagcacccagcgtgggtactgaggcgagaacgccggaaggcacgccagcacccagcgtgggtactgaggcgagaacgccggaaggcacgccagcacccagcatgggtactgaggcgagaacgccggaaggcacgccagcacccagtgtgggtaccgaggcgagaacgccggaaggcacgccagcaccgagtgtgggtaccgaggcgagaacgcctgccggtacgccagcacccagcaccggtacccgggcgaaagggccgtcagaagaaggcgaatcggacagcgacagcgtacattcgcataactccgggccattacgtaataccccgcctgagcgttcatcagaaatgcgcgctgcgggtgatacctctgcatggtggcactcgttcccggacctggcgaatatcaaaagcccaaagcctgagaagttaacccaggctgactatgaggccatcatcgccgtccttgaagctgaagcagagaagatgagcgagcgcattgccgagatgataccgctgccggactccttaccgacatcatcagcatcatcagtgacatccgggtcatctgcgtcatcagaagctgcagggcctgcaggatcgccagaacctgaagaaacgaaaaaagcctcctgataccacaccttaaaagccgcagcgatgcggcttttttttacgccgaatttgcgctgtctcacgcgctgcccggaactcccgcctcgcgctttccactcaatcgtaccccggtcatagcgggagaaaggcgccagtctggctggcgctaacgatgacgctttgttgagaggagagaagaatgaatatctcgtcaggttcggctttcgggccgatacagccgcaactgcctgattttagcgcgctcgatgaaaaaaatttagcctcgtttactccgccagattctggcgccagtggccaggcgattaactttggcaatgatgccatgagcggcacggatttcagtagtctcaccgccacgcccgacagtgtgagcaaccgggatccgatgcagatgcaggggctgatgcagcaactggggccgcaaatagaggcattgctgcaactgctattaatgctgcaacagctcttcgctggtcagcagcaaaataacagcgcaggagccgggcgtggcggcggtgccgatatgccgggcacctcagcagaagagggggcttcgctcaccgcaccgtttaatgccgcgatgcagcagcctgttaacccgactgaatccgcttctgcacagcaaccgctaacggccagtacaatgccacagccaggtacggcttctgatgctgcactaaatacgcctgcccggcagacgccagcatccggcggcgtcccgctgataaaaggcgagtcggggttacatttacctgccccgttactggatcatgagcaggcgataatgcgtgccgccaaagagactagccaggcgcctgaagtgctggcagcgcaaatctggcaggagtcgcgcggaaaaacagaggcgaccaccgtgaacggcggtaatggcctttccgacagcggcctgatgcaggttaattccaacaccttcgccgatctgcaaagcagatacccgcatctgctggggccagatgccagcccgtccagccctgaagacagcatcatggctggcgcgctctatctgaaagagcagcgggaggcttttgggggcgatcccggtgccgggttgcgagcttataactcaggcccggggaatgtgaatgtcaacgatctgacggatatctcgaaaaccggaaccggcgatccgacctatgttggaaaagtgctcaactttgccgacattatctccagcggcaaaggcacgttacctgcataacgcgcaaaaaaagtccctgtaccggatacagggacaaacatgagcagcctcaaaatcaggcaaacggcggcggttcgttcttgcctttccccccgctattttccaccgcaatctgtacggtatcggtcgctgccgtgatgccccagccaatcggcccacgcgccgcgctcattccaccctcggccagtcctttcaggccaccggtaaagacttcgcccacattgcgggcttcgccaatattgttaaagaaaggcgcggcaacagatttgagaatcgggatgttcgacaatattttgccgaactcacccatgccccactggaagttgtctttattggtaccatccatacgaacgtgcgaatcattcgtctccggcaactgtttattctccggcagcatcttcagaccctgttcggcgatatccttcagtacacccgcctcggtaccgtggcgcgcgtcaccatctttggtgatgccctctattttgtcgttagctgagatctccttccgctcgctgccatcacgcgcattcaggccttttatgctgtttaacacgcaggccatgttatacgccgcatcagcacgactcttcggatctttattggcatccgtccagtcgccgaagcgctcttttagctctgcctgcttgatatctttctggttgccaaggtttttcagcaccgggttttcatcaatgatctgttcggcgctgcggttatcacccggtggacgacccttcagattctcctccgtcggcctgacgcggatgtccttctcactggttcgcacgccatcgcccggtgcctgtggaatatcttcaccggatgtttcgctggcaaataacgccgtgggcaccgtcccttcttcagcggctgccggatcgacaagcgcctccaatccagcctgcgttaaaagctgatcaagctcccggatcggatcggacaggcccgccagcggcgttccgctcccaccggagtagctgatggggagatcgctgcccgggaccgggaccgggaaacgcggagccgggcaggggagtggataatggcaggttacccggcagtggcctgccgggtgaaaaagcgggggttattccccccccgccaggtattggcataaccatacaagccccctgagttagctttgcggatttttctgggaagattgcccctcaccgccgcccaaaagcccctgcaacaatgaagaaagccctaacagggacagcaggttttgcatcattccgccctgttgcccaccattgtcagttgctccctgagccggtgcctgtggtgcatttccgccagattcttcgctgtctgcccctttacctttatctatccccatcatctgctggagcagttgctgaagcatctgcatcagctgctcaagcgggttgccgctgtgattcgtgccctgtgaaggtgcaggcgtgcccggttgctccggctgctgcgccttattaccgccgcccaacagctgttgcaggcctgtcagcatcataatctgctgtagtaagccgccgcccgacggggcgtcaggcgagtttgcaccgtttgcctggccgtttttctgacttccgcctgaaccggtcagcgaagccagtgtgctcaggccgtcaaaggcattactggcaaaattgagcgggcctgttttcgcattattgagaaaaggtaacgacgattttccgggctgatcgggtaagtctggtttacctgacggactgccccccgtcttgcctggcatatttgccggaggcatatcgattttgttcgcgtttgtagccccaccaccaaatcctggaatcttcatgaatttattcctcagagttaataagtcagcgattgattggggcagcaacagcggtaacattttgcaatcctgattactgccgattgcacaattttaccgttcaggctgatgctacctcgcactgtgagtggtagttgtcccgtgatggttccactaaaaatgttccctttgtgatgcgggttcagatttataaaaatccagcggtaccgccattaagaaattatcattctgtatttgaaggtttttttgtgattcctgtagggtaatccttaccggttgagcgtctatccctacaagataataatcctggactgatagcggggatgacctgattgggtgagagtgaggccgcggtaaatttgtaattctttgcatcaggctctgcttccagaacatccacaagtgctgaacgagcagcgcgtctcatgtaaggcgcgcttatgcgaagctaatggagaatgtatggttcgtctttacaggacacagtcaggccacgggactgtcgatgaggagagtgcggataacgtcttacgccaggttgattcccgcccggatgcggcggcgggttacccggagcccgtaaccgatatccatactcatctgtataagattttaaatacgattgcaccgttaaacatagatgtcttaatcgagggagaaacgggtaccgggaaagatgcactggcccagcggctgtatcaactttccggctgtcgcggcccgatggtgccggtcaactgtgcagccatcccggagacacttgccgaaagcgagctgtttggggtcatggccggggcgttcaccggcgcaagcagttcccgcgccgggtatattgagagcgctaatcatggcgtgctgtttctggatgaaatagacagtatgccgctcacgatgcaggctaagctgctgcgtgtactggaaaatcgcgcggtagagagactgggcagcaccaaaagtatcgggctggatctgcgggtggtcgtcgcctcgcaaattccactggcgcagctggtggctcagggccgttttcgtcgggatctcttctttcgcctcgacacaattaaaattgccacgccaaccgtgcgatcacgaccggagctgattttgcccatgtttcgccagtttacgcaggaggcggcgctgcgtctgaatcagcccctgccggcaggatcgctcgcgcttgatgagaccctgctgctgcatagctggccgggaaatatccgcgagcttaaagcggcggcagaacgctttgtgctgggcttaccgccgctgtgctgtgagataaagcaggaagggcgcgtgttattaaaagacagaatgcggcgcattgagcgcagcctgatccacgactgcctgaaccggcacgacaatcgtatcgatgatgtcattcttgagttagggattcccaggcgcaccctttatcaccgcctgaagttgttaaaacttaccgcctgatatatcgcccacctctcttgccgtgggccagcaggcttaatctgcataaatattttctctgcgatggaaccggatagcttcattgattacttaatgaatgcaacacccaactacaacctatcatcaacgcgaggaatgactatgtcaggtgctagcttactttccaacgggatcaccaacgcagcttctgcttacactcaggttgccggtgcttacaacggtgcgaaatatatggttcgttcgcaacaggcgatggacaagatgcaggaaaaccaggccgataaaatggatcgcgatgtagagtttccagcgcattaacggcatcgccgaaagtaatgcgcaggccgcgtcagccgcagcccaggtcaaaattcagtactaatcgactccggcagggaggtgtttttttgtctccctgctctctaatgccacaggagttttactgatgaaagtctctcaatcttccttgctcacttcagaaccggttccgtcagtcgaaatgtaccaggaagcaccgtcggcggaagatattcaatggtttaatgcaaagcttaatggccctgcgcctgacagcagccagatgagctcttcagagcctggcgtggtcggcaatattctgcaatcgctgagcggcaaccagcgtgcgcaaaaagaagcctttaacgatctcagagtcgcttcgcggtcatccagtgcggaagatttctcccgcgccaatgcgcagctctctgattactatatcgagagtctgatgaacgccaaagtgattgccaaaaccgttcagtcagtcgataaactcagcaacctgcagtgaatcttatgaatggcgctgtcattaaatgcttctgtgctctgtgcctggcgctgctgcttaccggctgcggtgatcagactcagttgcacagcggactgtcagaaaacgatgccaacgatgtggtggcggaactgagccgctttaagattgaggcggaaaaacaggtttctaaagagggggttagcgttagcgtcgcgcgcaatgacattgagcgggcggtgaatatcctcaatgccgccggactgcctcatcaggcgcgaaccagccttggcgcggtttttcagaaaagtggtgttatctccagtccgctggaggagcgcgcccgctatatctatgcgctgtcacaggaggtagaagcgacactgtcacaaattgatggcgtcgtggtggcgcgtgtgcatgtcgtattgcccgagcgtatcgcccccggcgagccggtacagcccgcttccgcctcggtatttatcaaatatcatgaaaacctcgatccggacagtatcgaaccgcgcattcgccggctggtagcaaccagcattccggggctgggcgggcgcgatgaccgcgatcttgcgattgtctttgtcccggcgaaagcctggcaggataaaattgaaatggtgcagctggggccatttcagcttagcccggaacgttacgggatggtcaagatagttacaacatgcctgggagtgctgctgctgttactggtggcaaatgcattcatccgtcaggctctgagtcgtaagcgcctggctgcacaggcgaagtgattgattatgctcaacgctgcgcctgatgaggaaattaccctgcgctggttacgctggtggcacgctgacttttggttacaggctgatgaaagctggtgcacccagccactggcccgtttatctgcgcctttgcagaggcactatctccgccagcatgcctcgtgctggcaccacactctgggtgtatcaggcgaactggtcgcgccggagccgatggtgctggccatcagcgacttaagctgcgaacagcgcgcgcaactgttgattttagtcgcggaaatttgcgccggagccatgccgctacccgcagagctaaagatctggttgcggcgtctggcgaaaggaatgcgcattgagtgctggctgcccgccgggcttttcactactggcggcagcgccgacagcctctgtctgctgcaggcgttatttccggctatctggccgcgcctgcggctactcttccctgtaagcgacgcgccggtaaacccggcactttcactgcctggccatcgtctgcgtcctttatgggaaacggcgctctggcaggtgcaacaacattcgggagagacgcgcgatgtggaaacttaaaagcctgcatctgcagggcggcagcgccccaccgggtaatgtgctgcgccgcgaggaaattgcgctcaggcttgaagcggcttccattatcgagctggcccataaacaggcgcaaacgatccgcgagcaggcacgcgccgaggcacaagccgaaagggcggccagccagcgcgaaggggaagcccggttctggcagcaggcgcagacgctctttgcggactggcaggaacagcgtgcagccgaagagacgcagctggtgttgctcgctggaaaggttctgaacgaggcactgcaacacctgctcgatgaggtggatgatgagcgccgttttcacgcgttgctcagacagttgttgcgtcactatccgcgtcagcagcaggcgacgctgtattgcgccagcgggcaggagcaggagattaacggctggctggtcgcgcagccgcagcttcgctggacgctgtgcgccgacccggcgcttgagccagatcgcttgcggcttattaccgacgcaggcgagctgatggttaactggcggacgctgtaccagcagctcgcgccagcgctggcagaagagaatgcataaaaaaagcaaaaacagtggaactgcttcgcttgtcgcgccacttaacaggggtgtccaacaagaggagtcaatatcatgagttccagcgatctgttacagcgtcagttatcttccaactcaaaccgcaaacatcatgaagcctatcagtttgcccgcgatgtttcgggcgaatcgttcagcattgcggatatgtatgctttccagaatcgcctgcaggatatgtccaacgccagctgggcaagttcgcaatacacccagttcaggtttggtatccgtaaagcgatcatcgacgctgttaactaagcccctgtcatcaaggagtcaggcgtgtttacgttttcttttccgggccgcctgctggcggccattaccctgctgctactgagtatgggcatcacaaacgctcgtgtgccggatgagtggaagaatggtgcgtatgcctattcggcagataataccccgcttaatattattcttgacgattttgccagcagctttggtgttgaggtcaatcttggcacgctgggcgacagcaatgtcaccggtaaactgcgcgcagacagcccggaagcgttccttaatcgcctggcgcttgagtatcgctttcagtggtttgtttataacaacacgctctacgtcagcccgcaggcagcgcaaacttcccagcgtattgagatttccccggaagccgcgccggatctgaaagaggcgctgcgcggtgtcggcctgctggaaccccgcttcggctggggcgaactgccggatgaaggcgtggtattggtgaccggtccgccggagtatgtgcgccagataacggaatttgcccgtaaatcggaaagcaaacctgaagccggggccaataaagatatgatggcattcccgctgcgttatgcggccgtggcggatcgcaccattcgctatcgcgatcaggagctgctggtgccgggggtggccaccattctgaatgaactgctgggtcagtccagcaacgcctcttccggaagaatgtcatcaggccagggagaggatgaacaggtatcacgtgaacagtcgcaaagtgttttaaacgagctgattaatcgcaatatgccggcctccggacgtaaaaaggcgcctgtcagcagtctggcgggtaaagtatcagcggatgtgcgtaacaacctgctgctggtgcgtgacgatccgaaaacccgggacgcttatcaggcattaattaacgccattgatgttccgcaaaagctgatcgaaattgatgcagtgattgtcgatatcgaccgcagcgcgctgaaacgcttctccagcaacctggccggtcagtttggcagtgtcgccagcggtgccaatatgctctccggtgccagtacactgtttgtgaccgatttccagcgattttttgccagtatcgaagcgatggagggggaagggacggcatccattatcgctaaccccactatcctcacgctggagaatcagcccgcggtgattgatttcagcgatactgcctttatacgcgccattggcgagagggtggcggatattcagtctgtcaccgcaggcaccagcctgcgggtgacgccacgcgcaatcaccacttcacaaaaatcggctatccagctcattgttgatgtggaggatggcaagctcaataaagatgatgagggcgatgcgcagggaacccataacgcagcggtcagcacccaggcgctggtggaggcgcgacgctcgctggttctgggcgggttccattccaaagagacgggcgaccgtgagcggcgcatcccgatcctcggcagtattccgctgatcggcaagctctttacctcaacgcgctatgagacctcccagcgtgagcggctgtttattattacgccgcatttaattggtgaccaggtcgatccgacccggtatatcgctgccgagtcgcgcgaaacagcttaatagcgcgatggatgaggtgactaatcgtcataagtacaccgacgtcaaagggatggtggaaggcgcgatgcgcgacctggcgctgaaccgcgtgccagcggggatgaccagcggtggcacgggccagacgctttcctccctgtgccgcatttcgggcgctttcgggagcgatttccgtcgccatcagtggtacggcaacagcagcgtacagataaccgttggggtgatcaccaacaacacccagcagacgcagcgttttgatgagagtctgtgccgcagcgaccgcacgctggcggtagcggtctggccgcgtggagaactgcgtccgggtgaatcggcggaggtattcgtcgcatttgatagcaatgctccgtcacgtccttctcgcgcttcgctgctctcttcagcaggcggtgcaccggccaaaaacctctactgagctgataaggaaaaagcatgttagtgagaataattgtacttaccgccgccgcgctggtgctgagtgcctgcgcgcggccgcagggcggatgtaatgacgtgggctgtcgcccctcttcagacctgcataacctgaccatctggtggcaaccacaactgcgtaatggcccgaacgactacacgcggataacggtagataactaatcacgtttcggcagtcccaggccccggctgatcgacggggccatattttaatgagaatcgaccatagctattcaccttccgtttccgggaagcctgcgtgcggcgcactctttgcccgcatgccagtgctggtaatgctattccattacgtcagttttcctgcagcagaccgcaggcggctctgttatcagcaaccgcttgccggtttcaccccggcgacttttagcgctttaatactggcttttattcagcaggcccgtgagatgcagatgtgactgcctgataagatagtccggcgttaccctccgcactattcttcccgaatctcaatcacctcatccagatagtgatcctccagctcccgcagcagacgatagacgtgcgcgacggcatttaacgtttcgcgtggaacataagccccttcgcgcgtggtgcgccacagagtgcgggtcagccagataaagcggataaccggtctctttttacgctgcgcctcttcaattaatgcccgcgcctcttcatcgcaagccttaaacagcagacgcggcagcggcgtttcatccgggcgataatagagaccgacggcaaaatgggtgggattaaccagcaacacgtccgcgtcttccacgttaatctcacgggcaggcaccggctcttcattcaggatctcctgagccagctgacggcggtggcctttcatatgcggatcgccttcgctctgcttaaattcgtttttgatatcttcatgactcatacgctgctgtttgaggaagaaatagcgctgaataccaaaatcgaacaggctgattattagcatcaccatcagcacccgacgtgacaccttcataaacagcgccatcaccccctgccagaaaccgttgagatcgccaagcgccagctgagcaaggccaccgaggtccggcatgatcgcctgccataccaccaggcctatcaccaccgctttaaagatgctggtcaaaagctgggtaaactggcgggcggaaaacatattcttcagatgattaaacgggttaagcgcatccggtttcggtgccagcgcttcggtggagaagagtgggccgaaactgcacccagccgcccaccacccgcagcagcatggcaatggcgcacgcgatgcccaccagtaccagcattacggtgacgctatcacttattacttcctccatcgcgtgatcgaatgggtcgcgcagacgcgttaacggcagcagcatcatcgcctgcaaccgctgcatcccggtatccaccatagcaaacagggtctcaaggataccgattgagataagcagcttagggatatcctggctctggctgacctggccttttttgcgcgactctctgagtttttgcggtgtagcgtcttcggttttttcgctcatggcgcgctcccggctgaaggggcaaatatctgcgacaggacagggataagatcgcgcagttcatacaaccgcgcattacccagatggtccagcagtggcagatagaggataaaaaacaacatgccgagcaggcatttcaacggaattgtcagggcagtcgcctgtagctgtgggctatagagactcatcacaccgatggcaaaatcgagcagcagcatcagcgccaccggcggcccggcgtaaagcaccatatcgctgaagattttccccaaaagcgtaagccagacgtgaaaacccgcctctgcggggaaaggtatccactgggtggcggaccaaagatgatagctgtcccagatcacctgggtgatggtcgataatcccagccctgtgaccagcagcaatatcagcacctgctgcattaacttacccagaggcgtcacatccggccccagctgggggttaatttgtccacccattaaggcaccccgctggttatcgaataacgcaccgacagactcatacagccagaaaggcaacgccagcaacaatccgagcagggtgcctatcatcaactctttgagtaccagccctgccagcgccatcattgtcggctcaagcacatcaatttgttctttgatgcctggggcgataaacagcgccagcgccacagcaatggcggttcgcagcagcccttttatgacgctaaaagagaatatcggtgtcagtaacaggcagggaaagatgcgcgccatgccaagtcccagcgcgaggatggcatgaaacgtatcggtgagtgggtaacctgtcagcatcaggaactgaccgttgacatcatcgcaaacgccgcctgcgccagctccatcagttcaacaccgacccagcgcccggtaagcgccagcgtcaggccgaccgcgataagtttgatgcagaatggcagggtctgatcctgcaactgcatcgcggcctgcaccagtgaaataattaccccggagatcactgccaccagcagcggcggcgcggagaggataaccaccagcaataacccctggcgaaacagcgtcagaatatccatgatgacctcataaatagctgtagaacaggccgtcaagcagccgcgtccagccgctgatgagcacaaacagcaggatcttcagtggcagcgaaacggtcatcggcgacaccatctgcatcccgagcgccagcaggatattcgagacgatcaggtcaacgacaataaaaggaataaagatcagaaagccgattttgaaaccgttctgcagctccgatagcacgaaggccgggataatgagcagcatattttcgggggtgaccgaatctgccattttctttggccacatacgctgggcattttcctgcagatggatgacgatgtccggatcggtatttttatgcataaacgttttcagcggttcgataccattagcggcggtatattcgagccgctccatactgctgaaatcgacagggatcgctttcagcctgtcggtcatatcgctaaataccggcgccataataaatagcgttgccgccagcgcaatgccgttgagcgccatcgttggcggcacctgctgcacgcccatcgcgttgcgcgtcaattgcagcaccatcgtaattttcaaaaagctggtacagataatgagcatcatcggcagcagtgccagtgcgccgagaaacagcgccagcataatcgggttgagtggccccatctccatcggaatcacctgttcacatccccgacgctcgccacgcccggtagcatgtgagtaatctgcaaccccagacgtccttcgacatcgaccagttcgcctttcgccagcggaaactcgccgtgacatagcagtgcttcaccgggcacgacgttttcgaccgtgaccgtcgagccaacatccagacgatttaactcacccagggtaagtctgagatggccgcagcgcacggtcagggccagcggcagcgcatcaaaaggtgatgccacaggcgccgttgtttcagtcaggccttcatccgcttgaggtgtatcggcaggcagattatcttcgggggtcacattcatgtaactattctccagacgggtaataagaaaacgggcaggatgcccctccccgaacagcaattcgcccttaaggtgcaattgcgcaaggcgaagctcgccgcgaccggtcgggaaaaaatacgaggtagcagggaaaatcacatcaccggggcgaagtgtgcgtaactgcgagggagcaaacgacaccgcacccagttctatcggcagcgataacggcagggcgctgcaaagcggtgcagggagcggagcccagccaggctggtttaacaacgccgccaatgtggcgggggcaagatatagctgactttgcgcctgcgcctcaccgatcgtgacgctaatcgcaagccacatcccctcaaccggtgcgcagagcgcgtcctgcggcgtcaggtcgccaaatagcgcgcgcaatgccgggctgagatgctggttaaagagcggccagtaccagtcagcgcacgccccgggttctggcagcagcgggcaagtggaaaacagactcagcagcgcttcgctctccgccagagataaccctcccgccttgcatgagaagctctgcgtcggtggccgctcgccggggggggcgagccgcagctgaagctcacccgcttcgcctgcaagggtaaaaggatagccaaggccgtggccgatacgctggcgcaggctggcttcttcgcgcggcagagtgcgcagggataagggtttcattcccggcctccgcgctgctcaaaacgcaggcgcacagcgcaggccatccggcggcgcagggactcccggcagcgtttcctgatgggcggccatcatcgtcatggcaggtggcgcaaaacgcaggctgatatcccagcccgcggcaaaaggactcaggcgggcatccacttcgcctaaaaggggcagcagtagcgtcatcgatatcgggccagcaggctgcttttctaccatggcgcacagggggggctccagttgttgccaggccctggccggagaagcgggagccacatgctcatgggataactgtgacccaaaagagggggagccttcccagggtatgataagcggttgcggcagttcgctgggggtgagcaacagcgcgtcgaacagcgaaccctcttcgcgaaacggctcggtgcgggatttacgctcggatgtcgcgacgtctgaaggtccggtctgcggcgaacggcgctgcacctccggccgtgcaggcggcgctggattattttgcggggggtggggtaaggctgtcatcgtaatgcctcgctgtgcgccatcagatattccagtttttccacatcgcgcagacgcgcctgtgtttgctgctgtgtgtgctgcacctgttgttgttgcataacctgctgtgcgcggcactgttgcagctgattacgctgtccactcaccgcgtcgctggcctggcgctcccgggccaatcccccgaccagatgctcctgtttttgcagccccgactggtggtgtccggcaaagctatcgcgcagctgctgataatgctgttgtgcggcttcaagctggtgttccgcctcggctgactgacgttgcgtttcgcacagcgcctgctccgcttgccgctgcaaccgttcgcagcggcgtaagcgctggcggcgaattggcagcagcagagagaaggcctgctgcaattcagcgctgccctcatcagtcgtgatgtcgtgatcaggtagcggatgacggcgcatgctggcttacctccgctaagtaatgcagtgtgtcgtcatatccgcagggcgcgtgcatcgcctgttgcagatagccatttatcgcctcctgagccgatactgccgcatcggtcatggcatcatgtcccggctggtattctcccaggcggattaacatttctacctgctgccaggcggacatcatgcggcgcagctgcgtggcgtcgcggctatgctcgcgagtcgcaacgttgctcatggttcggctcaggcttgccagcacatcaatagccgggtagtgaccgcgctccgccagacgacgggtcagcacaatgtggccatcaatcagggatctcacttcgtccgcgaccggatcgttcattgaatcggcttcaatcagcacggaatagagggcggtgatggccccccgtgaggtctgtcctgcgcgctccagcagggtgggtaataaggtataaaccgaaggcggcagcccgccgcgacccggtggctcgcccagcgcaaggccgatttcacgctgggcgcgggcaaagcgggtcagtgagtcgaggattaacagcacgttcttacccttatcgcgccaggcttcggcgatggcagtggcagtaaaagcggccctggcgcgttccatactgctgcgatcggaggtggcgcagacgagcaccgtacggctgcgcagcgcctcatccagttcgtggtcaagaaactcgcgcaattcgcgcccacgctcgccaatcaaaccaaagacaatgacatcgcagggcgtattacgggcaatctccgccagcagggtggttttcccgcagcccgcgccggcgaagatccccacccgctgtcccacgcccagggtcagcgggccatcaatggcgcgaatgccggtcggtagcggcgtatcgatgcgcggacgatcggtgggtgccggggcatcgcccagtacgcctaccgcatcgtccaccgtaccgggcagggcgaaacgcgccaggctggcctgcatccagtggacggccaaagccgtcaagtacgctgccgagcagggcgtccgacaccacaatactgtgcggcaggcgcagcggaaccacgcgtgccccacgcgctatgccgtcgagctggccaagggcggagagcagcgtgtgctgcgggttaaagccgaccacctctgccagcacgctttgcccgtcatcccgggcgatctggcagagatcgccaatccgcgcctcgggcaggctgctttcgagcaatatcccgctgatcccggtaatgcgaccaaagctttcgaccggcgaaaagcaggtcagccgccgctgctgctgctgataccactgctccagtgtcatcgtcattaccagctcaccttaatgttatcgcgcccgttaaactcgatctggttactggtaatcgccaccagccgcaggttgtcgacttcatcgccaataaacagacgctgcccatcatcagtgacgatattggcgcggctaccggtggtgatttgcacaatgcgaaacggcagtctgaccttcagcagcctgacctggttatccagcgggatatcgctggtgtacgttgcgttaaagcgctccagcattcgtttatagatttgcatctgtggcttactgaggcggcctgtaagacgcagtcgctgattatgcatgtcaactttcacgaggctcgccagatcgcgttcgcgcaacattttctgtaacggagcctgcaattctgcgggagtactcagtggccgggaggaggtgacctgagtctgggctacggtgggctgcaaaacccagctcattactgtcagggtgagcagcaacatcaggctccagaccagcgtgcggatgctgcgggtgaatatccctttacgtgcagcgaccgggggtatggcctcattcggtgcttcagcagtttcttctggcacagaaggggtggcaggcggcatacaggcggcccacggcgtgtcgatacgcgcgacgcagagccagacgtcagcgacctgaaaaggttcttcactattaatggcataggcttccccgccgtgcggttgtgccagccaccgggtctcttcccggcgcagctcgcactggcgggcagcaacgcgagcatcgctaagcatcagatcggcctcatcggcgtggccaatcagccatttatcaccgaagaggggtaacgcggcgcctaaatgcaggccagacagcacgcgcagttcgaacatggttaactctcccacgtggtaagtgagtaagcggccggatcgagctctatacgccccagcacatttactgcgagattgggttgcagctctgcaaacgagagcaccggcacatagtggaactcttcctgaataagcccgcgcatcgggctgcgcaaatcctgggcgaccagcagcaccgcgctttccggggtgtcaaccgggaatgcgttggcgatgagcgggagaatggcgctgatctgctcatgggttagcgcaaagaacagatcgttttgagtctgacgaagcgagtcacgcaactgttcttccagtttccggtgtcagcagccagacatgcaggccgtccggacgggcatactggtaacagagatgattttttaacgagatgcgcacctggtcggtcagcagccagatgtcgcgctcatgctgcccatgctcgatcagcgcttcggcaattgcccgaaccgatcgcagcggaatgcgttctgaaaccagtttttgcaggacgctggagaaacgtgagaggggcatcacgcgctgtaactcctgcgacagctccggctgctctgattccagccagctcaccagcgcgcgggtttcctgcaggccaataaaatgcgggctgctggcatgaatagcgttctccatgcgctttaccaggatttcgcgcgccgtccagcgctcgacctcttcgttttgcagcagcggatgatccgccgccagccagataagatcgccttcctgacgctgctcgtcgccctctgccacgctttccctgtcggttgacgcgatctcgtccagccagcggcgtttcaccgcccgatgcgacacgttaaatgtcccttttactttcgggatttcataaaccgagaagcgaaactcatcttccgtctgctggtcgagaaactcgatatcgaacgctggcagggtaaagccgaagtggtaaacgatacggttacgcagccggcgaatatcctgcaccagctccagcatctccggatggccgcgccatgaggacgagaaattgatcagataaggtcgtgttgggttgaactgacgtaaatcctccttgccgttcagctcagggggaatgacctcattttccatttgcggctgcgcaaggctcagggtctttctgacacgccagatctgaaaaccgccgctaatcatcgtcagcgcggccagcagcaaaaaaattgccgttggcatacctggcagcagggcaaagcccaccatccccattgaggagagcagccaggctttcggctggctggttaactgctcggcaatctcgcggccgatattattgtcagccgtctgctcattgtcggacgagacgcgggtaatcagcatcccggcggtcagcgagatcagcagcgcagggatctgtgcaatcagtccgtcaccgatggtcagaatcgagtagatatgcatcgcttcgccagcaggcatgcccagctgcagcacgccaatactgatgccgccaatcaggttaatcacgacaatcaccagcccggcgatagcgtcacctttaacaaacttcatcgcgccatccatcgccccgaataactgactctcttttgccagttcattacgccggtttctggcctgtaccccatcaatcagtccggcgcgcagatcgctgtcgatggacatctgcttacctggcattgcatcaagggtaaaacgcgcagccacttcggctaccctttcggaacctttggtaatgaccaggaagttcaccacagtcaggatcaggaacatcaccatccctaccgcaaggttgccgcccaccacaaagttaccgaaagccgccaccacatggcccgcatcctgctgaattaagatctggcgggtggtggagatagagagtgccaggcggaacatggtggtgagcagcagcacggcgggaaaggttgagaacgccagcggcttaggcagatacatggccagcacgaccagcagagatgacaggcagatattcaccgctatcagcgcatcaattaatggcagcggtaagggaataataagcataaacaccagcgccatggcaaaagccgcaccgaccacttcggagcgttgcatggcgctgatcgcgattcgattcaatatctgaaacagggtattcatctttgttgcctcacgacgcagcgttccggttgcggcgttgctgttgctgctcagttttagtgacgtccgtaatcatgccgcgcagcagttttaacgcgttgtcacgattttcctgagcgggccacagcgaggctggcacgccgtgcaggagcggaaaaagcgaactaaaaaagagcggcagatgttgcctgttctggccgacaatctcgtctgccagcccggtaaaatcactctgataagcgccgttatggctgatttgcaacatccggcgtgccagagtcaggctgttcatggcaacactgggcagtttgctgcgcatacgctgcaaaaaggcagtgctgtcgctcagcgtctggcttatcccggcagcatcgcgcagtccgcggtggatacgtccgagggtaataacgctgattgagggggcaagtgcggcgatatcatccgccagcgcgcgctgcagagtacgcagcgtcgggatcagattacgcgagccgatcagctccagcagcatatccagcatcctggttgcggactgctggtggacgatgccgtcgtaatagaggttgcgcaacgactgtttacgctgcggatcgcgggtatacccggcgatggctgacgccgtgttgttgcctgcacgaatggtctggccgtgggtctgctgtagcttatccagctgggccccggccagcccggccagtttccccgtcgcctttatcctgtgcctgttcgccgatcacacgcagtagcagggcggtgcgcgccggatcgccgccggtcttttccagaagtgtgtcgctatccggcggcggattctggcgcagggcggcacgtagccacgccatctgctccagcgtttgttgttcatcgccgccgtcgagtagggaaaatagtgcattcagctctccgactttgctgagcgcatgcttgccacgctgctggttccgtgacgcattacggcggtcctgcgccttttgcctgcgttccatcttttcactgaacgcggcgcccatttcttccatcgcgtcattcagtgaggtttcacgcgcgcgaacattatccggcacgtcgtttttacctgctgtctgtggcgtgtttttatgcagagcttttagcgagtgcgccagcgccggtatcgcatgttgtattttgagcatcgccagccatcctcaatggttattactctctttctgtgtcaaataacgcttaccggttccgaaaaaagcggtaaaaaaaagtggaaataatttcatccggaaatcagtgcaattttttgcattattcatcgataaggaagggtaaaaactgtctcagataattctgtatggagaattaattgttttcataaacagcagcttatttgttgagcagcagatggcatatctcttgctatgtaacgaaatcaattgctactaatgagagagataagaaaatgattaattcaacgctcgtatccgctgtcgcagagtcacccttagcaattaacgtaaactgggatgagatcttcgttacgcataataagaagctgttaaatttcattcgaaaacgtattgccagccatgaagatgctgatgacatcctgcaaatgacctgtctggaagtgttgtgtaatcgccataagtttcgcggcgcatcccgtccggaaacgtgggtatttggcatcgcagttaatttgattcgcaactactacaaatcaaaacagatccactatctgtttgataatcttaatgatgaagttatcgccgatctgctgctggataatgatcccagcgatctgacggaaaacaggcaattactgagtcatacgctggcatccctcgaaattttaccgaaagacgtcagggtgatgctgtctatccttgtggaggaggagggcagctatcaggatatcgctcagcagttagaaatcccggtaggcaccgtgcgctctcggctctcacgcgcgcgggaaacattaaaggggagaatttacgcctgaatatgggcctgcgaaaaatggcaatttaactgctaagcttatcagctcgttaatatttagcgggttatgactatcatgccgtcggaacgttattctctgcggcttgataaatccgtggagggaataatgcttttacagggtgtatctgaccagaatgacaatgaaaaaactactatcaccggtttatcaaatattgccttaaacaaaattcatgatgcgatatatttgatagacagccagctgcatatcaaatatgtcaatgaaaaggcctgccagttgacgggatattcccgcgaggcattttcgcagctcagctttgacatcattgataaagaaactgcgcgacaatgatgtttttgccctgtggtggaaactcagtacccgccctgaaggtatacaattcacttcacatcataccggccggcatgacgtttttcccgtagaagtgagttgtagcggatatcaccaggacggtgagctgcatatcttatgcattgtgcgcgatatgcatgaaattcgccggcaaaaagagcagcagcaacttcgggaaaaacagctgcatcaggtagtggaaaattctcccgacctcattttacggtttgatttgcagacccgctgcctctatgccaacctggcggtccgcagctggtttaatcttagcgaaaacgatatcagtcgggtgccgctgactgaaagcgtgcagcgcggggggattggactgagcctgtttaagctggtctcacgcacgatggttgatgagaaagtggccgaagatgagctggtggtaaagcatcagggtgataaacgtaccctgcatgtgcgctgcgtgccggaatatgatttacagggcgagctggttagcgtgctggcggttgggcgcgatatcaccgcaatccgcaagaccgaagaggagttgcggcagttaactcataatctcgagcgggcgcgggaagcggaaaaaaaacagctggcgcgtgatattcatgacgagctgggccagcatttaaccgctctgcgtacagggttgtcgctgctggcgatgcgtaaagatcagcctgtcgatgcgcagcaggcaaaaattcagcagctgatggtgcatctggacagcacgattcaggtggtacgggatgtctcgacccgcctgcggcctaacgttctcaatcttggtttaattccggcgctggaatggttgcgcgatcagtttataaaaaacaatggaatccgctgcattttactggcacctgatgaacataccgtggtgctggatgaagcgacgctgacggcggcgtttcgcgtggtacaggagtctctcaccaatgtcgtccgccatgccagagccagcaatgtttatatcttcgtcaaactcacgccggatgcgctgctcatcgaagttgtcgataacggtaaaggttttcatctgaatcgagtgaagaaagggacgtgtgggctgcacggcatcagggagcgaggacgcatgctaaatggagaagcgaccatcgatagtacacctggtaaagggacccgggttaaactgaaattccccctctctgtaagcgctaaatcagtcgcatcctgtccgaaaaccgggagtattaaccgatgagtaaatgcatacgtctgatgattgccgacgatcatgccattatgcgcgagggcctgaagcaaatttttgctcttgatgacaatatcgacgtggtatgcgaagcatcggatagcggccaggtgctggagcgcctgcggcagcacgaagtcgatctgctgctgctcgatatttcgatgcctggcatgagcggagaagatctgattacccgcctgatgcctctctatccccggctgcgcattctggtattgagtatgtacaacgaaccgcaaattacccggcgggtgttaaataatggtgcgctgggctatatcaccaaagacaagtcgccggatgttttactcaaagcgattcgtaccgtggcgcagggatcacgctatatcgatcacgatctggcacaggagattatcttctccgactaccagagcaataatcgtgcgcctcatgagagcctgacgatgcgcgaaacggcaaatcatgatcatgctggcccacggggagtcgattaatgcgatagccgatgcgctctccatcagtaataaaaccgtcagcacctataaatcacgcatgatgaagcgaatgaaatttaccaataatgcccatatcgtgaaatattctctgcagcataacctggtgcaataacgtcttaaggctccgcctgataagcctcgggcggggtcgatctgaaagtgttttgcagcacggctaatgggaaggacgtgtccgcctgaattttaccccgaccgaataataaaaaatccacgccatggcgtggattttagggagtctgtcagacttcatggttttgatgtaacccccatgagacaacaatctttaatcagacgttgaacaggaagttcatcacatcgccatctttcacgatgtactctttaccttctgaacgcatcttgccggcttctttagcaccttgctcgcctttataagcgatgaaatcttcaaacgcgatggtctgggcgcggataaagcctttctcgaagtcggtatggattttaccagcagcctgcggagccgtcgcgccaaccgggatagtccatgcacgcacttcttttacgccagcggtgaagtaggtctgcaggttcagcagggagtaaccagcgcggataacgcggttcaggcctggctcttccagtcccagctctgccatgaactcgtcacggtcttcatcttccagctcagcaatgtccgactcaacggcggcgcacactggcaccacgactgaaccttccgcttcggcgatagcgcgcacctgatccaggtacgggttgttctcgaaaccatcttcattgacgttagctatgtacatggtgggtttcagagtcaggaagctcagatagcggattgccgctttgtcgtcctcatccagattcagtgaacgcagcatgcccgcttcagaaagatgcggcagacacttctccagcgcagccagctcggctttggcatctttgtcgccgcctttggctttcttctgcacgcgctgaatcgcacgttcacaggtttcaagatcggacagcgccagctcggtgttgatcacatcaatatcttcagccgggttcactttacccgccacgtggatgatgttgtcgttttcaaagcagcgcaccacgtggccgatcgcttcggtttcacggatgttggtcaggaaactggttgcccaggccttcaccttttgacgcgccttttaccagaccggcgatatcgacgaattccatggtagtcggcaccacgcgctgcggcttaacaatctcagaaagctggtcgagacgcaggtcaggcatcggcaccacgcccgtgtttggctcaatggtgcagaaggggaagttagccgcttcgatgcccgctttagtcagcgcgttaaacagagtggatttaccgacgttcggcaggcccacgataccgcatttgaatcccatggtttgataccctttataactggatggacagtgcgccagaaggcggactgtcggagacgaattgaaaaatttcgcgcattatacacggaatcacgacgattcgggcgtttaagcaggcttgaaggcgtgcaaccggttcatcgccttgatacgatcctctttcagccacagttcggtgcagcgcgccgcctcatcaatggcatcatcaatcagcttctgctcactggcgggcggcttgcccagcacaaatccggtcaccttgttgcgatcgccgggatgcccgataccgatgcgcagccgatggaaattgttgttgttgcccagtttgctgatgatatctttcagcccgttatggccgccatgcccgccgccctgcttgaacttcgccacgccgggtggcagatcgagttcatcatgcgccaccaggatctcttctggcgcgatgcgataaaaggtcgccatcgccgccacggctttcccgctcaggttcataaaggtggtcggcaccagcaggcgcacatcctctccggctatcgccaggcgcgcggtatagccatagaatttgccttcctctttcagtgactgattgtggcgctcagccagtaaatccagataccaggcacccgcattgtggcgcgtggcggcatattcagcgcctggattggcaaggcccacaatcagtttaatgctgctcacaatgattatcctgctgttatcgcgaaagggcgttagtttacttcgccatggccgagatgacaaagtacaagcaccgaaatggttcatgacggtgattaatcattttccatctgaatcaacaggctgcaatcagggccagttaattatttatggctgatgtgtgatccagtccgcaacgttatcttcacccattgcctaagcttatggcacttaacattgtgtgcggttattgactcatatggatggaggtgcagcatgaaacatcaacactgccgcgtagcgggtaacagcttgatggtactgggattagtcacaatggtgctgggcgtgggtttctcaattatgaaccagcttccctcgcttgatctgccagatgcgctggcgcagggcgcaatcttaggcatctttgttggtgcaatgatgtggctggtcggggcgggtctgagtggtcgtgaaaaggttgaagatcgttattactggcatcgtcactatgacaaacgttgtcgccggtcgcacaattctcaccattaactgatgccagcagtgaccggatgctgcgcgatgcggtttccggccgctggccttggcgtgatagagcgctttatccgccagtgcgagtaaatcgtcaaaaccctgctgctgatgtgtgaccgtggcaaacccaatgctgaccgaataggcaattgaattgggttgtgacgcacagacctcccgccgaatcgtctcgcaccaggcctctgcctctgttgccgcagccggaattattgccgcaaactcctctccacccagtcgcgcaaaacgcccctcagccggtatcaatcctctgacgatgtcgcaaaagtgaatcaatatctggtcgccctgttgatgaccataccgatcattaatgctcttaaaatgatccagatcgaacagtatcgcgctaaaaggtcggttctgacggcggcatcgcgccacaatcttctctgcttcattaaataaagcccgacgattccagacgctggtcagaggatcgtgcatcgaggcatgctttaagactgactgcatccgttcattcaccatggccaggatagtaaatgtcagaccaatgacaaacagaatcgattccaggatgacgtaaatcgagaagtttgatccgccaatggcgccaggcagcgtgctgggaatcgcgctatccagaaacaggcgagccagatgaaacagcagatggatccacagcagcaactgcgcaggccagaaggtcacctttagcgtggcacgcgccagccagaccagctggatcagtgcggcggtataggcgatgcaggcgatgcagagcaccagcacccgtttgggtaagctgtaatagaacgccgggaaacagcagaggagtgcccagagcagggcgcccaatagccagtgagtgccgatgggcttgccgcagaagcgccggaacgcatttaacaatccgccgtaagccagcatcactaaaacgttacccactgcaacgggcaggaaatgcaggtcactgctgcgcaggctacttaagaataccgcaatcagggtaaaaaccagcgacaggcaggtgaagccgagaacgcgatcatactgcgatccgatccaggcaaaaaacatgatgatgctcagaaaccccagcacataaagctcgcagacaaataacgtatagatatcgaggctcatggcggtcagggttcttatgaaaagtgcgctgcaaattaccacttaacggcacagggcagaagcggggaacgcggcgttttatcaaaagagtgggtggcgttgaaaataggcgattttggggaaatttatcgcgaaaatatcagaaaaagaagcgcgttaatcgggcgcccggcaggcataaaaaaaccgggcacagggcccggttccgcgaagattaatgctcgaacattgccgagattgattcttcgttactgatgcggcgaatggcttcggccagcatgccagataaggtcagcgtgcgcacattcggcagtgacttaatctcctgagagagtgggatggtatcgcagacgattacctggtcgagcacagatttacgcaggttttcaaccgcattgccggagaaaatcgggtgggtcgcgtaagcaaagacgcgtttagcaccacgctctttcagcgcttcagccgctttgcacagcgtgccgccggtgtcgatcatgtcgtcgaccagcacgcagtcgcggccagcaacgtcaccaatgatgtgcatcacctgagaaacgttcgcgcgagggcggcgtttatcgatgatggccatatcggtgtcgttcagcagtttagcgatagcacgggcacgtactacgccaccaatatcgggagaaacaacaatcgggttttccagaccgatctgcatcatatcttccagcaggatcggactgccaaatacgttatcaaccgggacgtcgaagaagccctggatctgctcggcgtgcaggtcaaccgtcagaaacacggtcaacaccgacgctggaaaggaagtctgccactactttagcggtgataggtacacgcgcggaacgcacgcggcgatcctgacgggcataaccaaagtaggggatgactgcggtaatacgaccagcagaagcacgacgcagcgcgtcgaccatcacaaccagttccatcagattatcgttggtgggggcacaggtggactggatgatgaaaatatcaccaccgcgtacattttcgttgatctgtacgctcacttcaccatcactgaaacgtcctacagcggcgtctcccaggctggtgtaaaggcggttggcaatacgttgtgctagttccggggtggcgttaccagcaaatagcttcatatcaggcacgagaagaacctcaggctttgcgtccagagaatgaacggcatgactgtaaccggcgcgtacggtcatgtgcgttcacacgggtgtgttgatgcgaaacgtgcagtgtccggaacgtggtgacactgtcacgcattcgctaatcgcctcgcagggtacgctgtagcggcgaaacatttacgccccgggctacaaatgcgcgtaccccattcggggcaagctccagcacctggcgggcagcagactcggtgtcgaattcagcaaacacacaagcgccggtgccagtcaggcgtgacggcgcgtattctagcagccaggaaacaagctcatcaacctcacgaaaacgttttcttaccactgcttcacaatcattggtgaagggtgatgctaaaagcgtcgataaactgcgcgatggagtatctcgcgtcagttcggggtcgttgaatactactggagtgctgatattcacgccgggatgggcgacaagataccacttttcttccggctctgcgggatgaagttgttcacccaccccctgggcgaaggccgcgaagccctggacaaacaccggcacatccgcgcccagcttcacacccatcgacgccagctcatccggcgtgaagccggtttgccacagatgattcagcgccaccagtacggttgccgcatcagaggagccgccaccgagaccgccacccatgggcaggtttttctcaacggcaatctgcgcgcccgcgtgagcggacaggcgattgttatcctgcgccgcctgtttcagcatgtttgcggcgcggacaatcaggttatccgcatccgcaacgcctgccacgggcgttaacagtgtaatcgagccgctttgatcgacggtaatctgcagttggtcaccgtaatcaagaaactgaaacagcgtctgcaggttgtgatagccgtcgggacgacggccggtgatgtagagaaaaagattcagttttgccggggcaggccagtgggtgatcattgaacggtccagccgtccatacgcagtttaatccgctggtcaccctctttcagctccaggctcgacggcagcggcggggtgactttgctgtcgtagcccgcaatagagacctgccagttctgaccgtcgcggctgtagttcaggctgctcagctgatagctctcattgagctgatagtcggtggcatcgcctggcagacccatcatccactggcgcagattcgccagcggaatgttcatgccggtcagctgcgaaatcattttctgcgcatcgttgctgacgtaacgcttgcctttgttatcgacgatctgtaccaccgagccttgcgcatccagctgcagttcggtgctgccgagcggattggtcagcagcaggcgatagcgatcgggcgcggtctgctgccagttaaagcgggcatagactttctgcttgtcagaaagataggcaaaggcgccgcgggtctgatagtgcgtgacctttgagaccgcctgctgatgctgttgccactgtggcgcggtaacgctggggcccgggccttgcggtttgttgacgctacaggctgccagcagcacgctggcaaggggcaaaaggcgcaacagattgcgtggtgaattaagcatcaagtggtcatctcctcggacacatttattattcgtaacggataacgctaaccgtcccggttttaaccgtcaatgctgttatgcagcaaattgagcacgatcgggttaatcttattacagtcatagcctttgtatggcttttcttgatctgccgcatcttgtagaatgcgcctcacaaaaccctgacattattgggacatcccaaccaaaaccgctatgacgctgctcgctctcggaatcaatcacaagacagcccccattgctctgcgcgaacgcgtctcgttcgggccggagacgcttgagcaggcgttaaacagcctgttatcacagccaatggtgcagagcggcgtggtgttgtccacctgtaaccggactgaactctacctgagtgtagagcagcaggccgacttacaggcgcgtctggtgagctggttatgcaattatcatcagctggatgaagaggatgtgcgaaacagcctctactggcatcaggataacgaagcggtcagccacctgatgcgcgtcgccagcggactcgactcactggtgctgggcgaaccgcagatcctcggtcaggtcaaaaaagcgtttgccgactcctcacgcggtcaggcgctgagcagtgaactggaacgcatgttccagaaaaccttctcggttgccaaacgcgtgcgtacggaaaccgatatcggtgccaacgcggtgtcggtggcgtttgccgcctgtacgctggcccgtcagatcttcgaatcgctctcttccgtcaatgtcttgctggttggtgcaggtgagaccattgagctggtggcgcgtcatctgcgtgaacatcaggtcaaaaatctgatcatcgccaaccgtacccgcgaaacgcgccgaaacgctggcgtcggaagtgggtgcagaggtgatcaccctggcggagatcgacgcccgtctggcagaagccgacattattatctcgtcaacctccagtccgctaccgattatcggtaaggggatgatggagcgcgcgctgaaagcacgacgtaacaaaccaatgctgctggtcgatattgcggttccgcgcgacgtagagccggaagtgggcgacctgcctaacgcctatctctacagcgtggatgacctgcaggcgatcatcgagcagaacctggcgcagcgcaaagcggccgcggttcaggccgaaagcatcgtggttcaggaaagcagcgaattcatggcgtggctgcgctcacagggcgcggtgaatacgatccgtgaatatcgttctcaggcggaagagatccgcgctgagctggaaggccgtgcgctgcaggcgctgcagcagggtgccgatccgcagaaagtcatgcaggaactggcgcacaagctgaccaaccgtttaatacacgctccaaccaaatcacttcagcaggccgcccgcgacggcgataatgaacgcctgcagattttacgcgacagcctgggtctcgattaggcacaccgctgtcgccacctgttacgggaatcccacatttaaatgaaaacctctatagttgccaaactggaagccctgcaggagcgccacgaagaagtggaagcgatgctgggcgatgcaggcgtgatcgccgatcaggagcgtttccgtgcgctgtcacgcgaatatgctcagctgaccgatgtgacccgttgcttccgcgactggcagcaggtgcaggaagatatcgaaaccgcgcagcagatgctcgacgatcctgaaatgcgtgacatggcgcaggaagagttgcaggaagcgcgtgagaagagtgacgtgctggagcagcagttgcaggttctgttgctgccgaaagatcccgacgatgagcgcgcctgttttatcgaagtgcgcgccggaaccggcggcgatgaagcggcgattttcgccggcgatctcttccgcatgtacagccgctatgccgaagcgcgtcgctggcgcgtggagatcatcagcgccaacgaaggcgagcatggcggttacaaagaagtgatcgcccgcgtgaccggcgaaggtgcctatggacgcctgaagtttgagtcaggcggccatcgcgtgcagcgcgtgccggagaccgaatcccagggccgcattcatacctcagcctgtaccgttgccgtgatgccggaaatcccggaagcggaactgccggaaatcaatgcgggcgatctgaagatcgatactttccgctcatccggcgcaggcggtcagcacgttaacaccaccgactccgctattcgtattacccacctgccaaccggtatcgtggtggagtgtcaggacgaacgttcacagcataaaaacaaagccaaagcgctggcggtgctgggctcgcgtattcacgctgcagagatggcccgccgtcacgccgccgaagccagtacccgacgcaacctgctgggcagcggcgatcgttctgaccgtaaccgcacctacaacttcccgcagggccgcgtgaccgatcaccggatcaacctgaccatctaccgtctggatgaagtgatggaagggaaactcgacagcctgattgagccgattgttcaggagtaccaggccgatcagctggcggcgctggctggtcaggattaatggatattcgtcactggctgaaacaggcggtcgccacgctgtgcggtggtgacagtccgaagcgtgacgcagagatcctgttaggttttgtgaccggcaaatcacgcagctggttaatcgcctttgatgaaacggtgctcagcgaagaacagctgacgcagctggatagcctgctggcgcgtcgcgcccgcggtgagccggtggcgcatctggtgggcgaacgcgagttctggtcgctgccattgcgcgtcaatgacgccacgctgatcccgcgcccggataccgaactgctggttgaacaggcgctggcacatctgcccgcgacaccggcaaccattctggacatgggcaccggcaccggagcgattgcgctggcgctggccagcgagcgtcccgattgtcaggtcaccggcgtggatcgcattgaagccgccgttgagctggcgaacagtaatgcgcagcagctcagcctcaccaacaccacctttctgctcagtcactggttccaggcgctgacgccacagcgctttaccctcattgtcagcaacccaccctacatagatgccagcgatgttcatctggagcagggtgacgtgcgctttgaaccgcgcagcgcgctggtggcggatgaagcgggactggcggatctgcgtacgctgatcgagcaggcacctgcgtggctgttgccggggggctggctgctgctggaacatggctggcagcagggcgaggcggtggccacgctgatgcggcaaaaaggctatcacgccgtggaaaccgtcgatgattacggtggcaatccgcgtgtgaccttaggccagtttcccttcataaaagcgctttgaaaaggattcatgatgttcgccttttatcccctgattaaaaatctgcacatcttaacggtggtgcttaccgtgacgctgttcctgctgcggttttactggctgcgccgtggatcggcaatgatgacgaaacgctgggtgcgcatcctgccgcacgctaacgacaccctgttactggtgaccggcgtctcgctggtgatgattacccacttctatcccttcacaccgcaaggaagctggctgacggagaagcttttagcggttatcatctacatcgccttaggatttgtggcattgagtcgccgtccacgcactgatcgcacccgctggatcgcttttctggtagcgttaatcgccatggtggccatcattaagctggcgctgaccaaaatgccgttatggggatagcatgacctcgaccgaacaattagatttcagccagacaccgctgtgtgaagcggtgattggtgccacgcttgccatccgcgccgatttcccggcgttgtcggtggaagcacaacttgcggcgttagtcgccgaagcacgtgactatgtcagccataccgaagatgctgacatgcagctcgaaaagctgctggagctgttctatcgccagtggggattttgcggtgccagtggcgtctacaatctttctgatgctctctggatcgacaatgtgctgaagacccgtcggggcacggcggtgtcactgggcgttatcctgctgcacatcgccgccgagctggaactgccgctgatgccggtgatcttcccgacgcagctgattctgcgcgccgactggattgatggtgataagtggatgatcaacccgtttaatggcgaaacccttgaccggcacacgctggaagtgtggctcaaaggcaatatcagtccgacagcgcgtctgtatgacgatgatctcgacgaagccaaaaccgtcaccgtgatgcgcaagatgctcgacacgctgaaagcggcattgatggaagagaaaaagatggagctggcactgaacgtcagtcaggtgctgttgcgtatcgatcctgacgatccctacgaaatccgcgatcgcggtttgatctatgcgcagctggagtgcgaacatatcgccctgaatgatttaacctacttcgttgagcagtgtcctgaagacccggtcagcgaaatgatcaaagttcagattcacgcaatcgaacaaaaacaggtcacgctgcactaagcggacccactgaaaaggaaagggcatgacacagaaagtcgtgagtattggcgatatcaaagtcgcaaacgatctgccatttgtgctgtttggcgggatgaacgtactggagtcgcgcgacctggcgatgcgcatctgcgaacactacgttaccgtcaccagtaagcttggtattccttacgtattcaaagcgtcatttgataaagcgaaccgctcctctattcactcctatcgtggcccaggcctggaagaggggatgaagattttccaggagctgaagcaggctttcggcgtcaaaattatcacggatgtgcatgaagcgtcccaggcgcagccggtctctgaagtggttgatgtgatccagctgcccgcgtttctggcgcgtcagactgacctggtggaagcgatggcgaaaaccggcgcggtgatcaacgtcaagaaaccccagttcgtcagcccgggtcagatgggcaacatcgttgataagttcgctgaaggtggcaacgagcaggtcatcctgtgcgatcgcggcagcaatttcggctacgacaatctggttgtcgatatgctcggctttaacgtgatgaagaaagtcaccaaaaacagcccggtgattttcgatgtcacccatgcgctgcagacgcgcgatccgtttggcgcagcatcaggcggtcgtcgtgctcaggtggctgagctggcgcgtgccggtatggcggtcggcattgccggtctgtttatcgaagcgcacccggatcctgaacacgccctgtgtgacggcccgtccgcgttgccgctggataagctggagccattcctggtgcagatgaaagcgattgacgatctggtgaaaagcttcccggaactcgataccagcaaataagtttgctgcaaaaaaaagagcgatgattcgctcttttttttcgcctgaagacgggtgacgttacagcatgatggtcatcagataaccgataaacaacgccagatgcgcggctccattcagtacatttgtgcgtccggtcgagaaggagagctgacagagaatcagcgacgccatcataatcaccatctgcggcggctccagaccaaatatcagctcctgtccggtcagggtggcgataatggttaccgccggtaccgtgagtgagatggtcgccagcactgaaccaaagaaaaggttcatggcgcgctgcacctgattcatcagcacggccctgattgcccccaggccttccggtgagaggatcagcagggccaccaggaaaccggtaaactgtgccggtgcattcagatccgtcagcaggctttccagcgtattagcattcatcttggtcacggcaatgaccgcaatcagatgcacgatcagccagctggtatgccagaagctgctgtgggcagacggtttgccatgatgcgggtcgccatcatcgctctcatcttcatgctcatagacaaacaggctctggtgggttttggtctgaatcagcaggaaacacgccatacatcgccgctgaaatcgccgcgatcagcagtgcctgagtgacagagaaattaccgcccggcagtgcgttgggaaacaccagcaccagaatcgccaggggaaagatagcgatcagatattgcttcacgcccgccagattcacgtattgcgtcgcaaacttattaccgcccagcagcagcgcaaagccaaccagtccaccggttacaatcatcacgatcgaatagagcgtatcgcgcatcagcccgggtgcggcatcgccggtcgccatcagcgccgagatcaggctcacttccagaatcaccacggagagactcaggatcagagagccatagggctcgcccagccggtgcgccagcacgtcggcatgtcgtacaacgctaaaggcgctgctcagaatggcaaccagcgccactaagttgataccgactacaatcggaaatgatgtggttgcaccaaaaaaatagagtatacccagcgtgataaggggaagtatcagcgagaattccttgtgacgtgttttttcatgtgaaggcattcaccatcctctctggttaatgattatccggacacagcgagtgctgctgttagaaatataatcagttttagggcagggcgcagtttatcttttcaccggtccgaacgggaaaaatttactgctttttactcaaatgcaataaatggtcgaagcggtattaacctgaagttatctcaaatattgcaatattaatcaggccacaacaatttctctttaaccatctatctgaccgccaaatgccgtaaaatctgtttatcattgtaacttgtgtggcctgtttctggtttttaatttgaaggggagataagtggctgtttgtatttttgttctgttgcgccaggcttaacaggaatccataaactgaggagccgttatgccttactctaaacgaaccgacttacctgacaacgtaaaacacgtgcttcccgcgcatgcgcaggatatctatcagcaggcatttaacagcgcgtgggaagaatataaagaggctaaggatcgacggggcgatgattcgcgggaagaggtggcgcacaaagtcgcctgggcagccgtaaagaaagagtatgagaaaggcgatgacgataagtggcatcctaaacgttaatgccgtcgctagcctgttcacgccaaagggccaggattatctggccctttttttcatcttcgctataaggtttatctggttttttttgacctgcgaccggaatcacgcttgtaaccccgcgcggaaatagattaatgtcaatttgatgaacgaaacgcagcgccgttttggagatcatgttacaggagccattctgcaggacgccgttgacgttgaggaggtcgcattgcttacccgggaatttctattaaaagcggattgtaaaacgtcgttcggggatatcgaagaggcgttgctctggagttgcgagcagcgcgcggcctcgctggcagccacgctggcctgtcgtcccgatcacagcccggtatggatctttggttacggctcgctgatgtggaacccgatttttgaggcggatgaagtggcgtccggttcgctggagggctggcaccgtgctttctgcctgcggctgattgccggacgtggcaccgccgcgcatcccggtcgcatgctggcgctgaagcagggcggcagaaccacgggtctggcgtttcgtctgccggaagagcggctgcatgaagagctggcgctgctgtggaagcgtgagatgatcaccggctgctatcttccaacctggtgtgaattacagctggaggatggtcgcagcgtcactgcgctgacctttattatggatccgcgtcatccgttgtatgaatcggactcctgcccggaggcgattgcgccattgattgctgcggccagcggcccgctgggctcgaatgcgcaatatctgtttgctctggaagaggagctgacccggcgcggcatggaggaggagagtctgagccggctggcccatcaggtgcgaacgctgcagcaagcctgtctgaagcaggcctgaaccggggcataagcagagtaaaagggcgcgacagtgtcgcgcccttttacgatccggctgcgggttaccgggcttagttacccggattaatcagccaggtaccgggcttatcgatggtcagggattgtgtgtgcgtctcactgccattcttaacgtcaattttgtactgtcccgccgccagattcagtgcggcaaatccgctgctgcccggttttacctcaaccggctgtccgttaagcaccacgctttcactgctctccagcttaagatagacggtcgccagcgcggccggaacggcagcggctgacggaatcgatgcgggcgcctgcgtcatggctgagctattgttaaccacttccggtgtggcactgtggcgattcgccagccagatggcgacaaccacggccagaatagccacggcagccaggcccagcaatccaggcgacagtttacgcaccgtgcgcggcgtcaccggctcggcggatgcggcggcatgattcatcgccattaccaccggcgcagcagcctcaaccggctcctcgaccggcagagcaggcgactcgcccggcaccgggaagctgtttaccaccgcttccacatcactgaccggcagatcaatcaacgcggcaaaggcatcaatcgtttgtgggcggtcgcctggcttcattgccagcgcgcagtcgatggcatgcagcagcggcagtgagtagccttctggctggcgttccaccagcggctgataattatcttcaatgcagcgcaccacgctgaccggcggcggattaccggtaatcaggttatgcagcaccgcgcccagggcgtagatatcggtccacggcccctgttcaacttcaccctcttcgctgtactgctcaattggcgcaaagccaggtttaagcatgatttccgtttcgtcagagaggttgccaatctctttacgagccgagccaaaatcgagcagaaccggcagctggttctcctgaatctgaatattgtcgagcgagatatcgcgatgcagatagccggcctgatggatggtgctgatagcacccagcagtggtggcagcaggcggcggatccaggcttcagtgatcgacgccgggctggttacctgccactctttcagcgtcataccgctgtagtagagcgtgcccatataggctgtgccgttctgctcccagaagcgcagcacgtgcagcagtcccggatggttaaagcgggccagcagacgcgcttcctgaataaagctggtgagcccggcattaaacagcttctggaaacgctcaccgcgcagctccagcgttaagtcggcggcacggactgccagcgacaccggcatgtactctttgattgcaatagtgcgttcaagctggtgatcccacgcgcgatagacgatgccgaagccgccgcctccgatcacttccttgatctcaaactcattgaaacggtatccgtcaggcagggcattcggaacggttttcggattatcatttgccgacatagtgaactctctgtacacggcctgctcgccaggctgcgcggtaattaattgatgttacgccaggcaccaatggcaggatcaaccagatccgcgtgcagggtgtcgatgagtaacacattcactttttgctgtggcatgaaatagggcgcccagtggctgcgcaacgtatcaactcgcgatttcacagcgtcagcatcctgctgcgcagcattcttatccatctttatcaacagggcaccattgaagcgccagacatgttgtttggcatcaaagggaagcaccagccagctatcattcgcatccgggcgtgtcacaatcatgcgctgattgttcgcggcgataacctccagcttgctgtccgggatcgtcagattggcgatgggatagccctgataaaaggtgactgccaccggcgttgggtggtcaggggtcgccagcatcagctcacttttgccttctgcccagccatccggtgagcactgctgcttgctgacatccgggataaacagggtctgggcattttcatcccaggcggtgcgaaaatggcagccgctggggagatcaaaatgttgcagcggcgtgctgttggcgggccgagacaggtcaagcggtgtagcattactctcactggcgctggcggtggcatctgccatcacgataggacgccagtttctgcaacttactggcgctgccgctggccagtacgccaccctctttactggtcatctgccagggcagctcgtccagtaatccgcactgattagcaagcagggtgccgacgcgcggtaaaaaggtggtcagcaccgccgaatccttacttttgccggagacgatgcgcagtggcagcgtctctttgcaccagtcgtcaggcgctttactcaccacattatcgatatagacctccagcgccaggctgggggagtagacaacccgataattttcagcctgggcgtgaaaggcaatcagcagggtgatgatgccgggcaaccacagtttcataaggatccttggaatcaaaaacgaggcggcagaaagcgtgccgaatcagccagtgaatagagcagcgttgcctcctccggctcaccaatccagaccgccagtgcgctgagattatctttcttaacgttgcggctcaccgcctgttccatcagagccagccactcttcgcaggcattcaccatgcgcagcgcctgttccatttcatgactggccagattcagccagaagccatcggtgcagaccagaaacgcgtcgccatcctccagcgcaatctcctgcgaaaagcttactaagcgaggcggttcagcgccgagcgcattatagagtaaattactgttaatgccggtattttcatagcccgcttctttcagctgctgggccagactgtgatcgcgagtgacctcatgaagcacgccgcggcggaagtggtaaacccggctgtcaccggcatgcgcccaccatgcgcgctgtttttcgcggtcgataaacagggccgccagcgtggtgctcatgcgtgaatatttcggatttttaccctgtgcctcatgcagcgctaagcggcactgttcaattgcctgatgggttatttccggcgtcaggtcggcgtgtgcctttaactggctcagcagggtgtcacgcacgagctgtgccgccatctcgccgccgggcagaccggccacgccatcgcagaccacaaaacaggctttacgctcatccagctctgcgccggtgcgatcctgattctcatcgcgtagcccctgctggcagcggctggcaaaaacgattttcatggttcatctacccgcgtctgagagtccttatactgattcacctccatgtcataggcatggagaaaggcctcgccaaacagcgtatggaaatcatcttcgatctctccggccgtacgctgataattacgggtgaagtagtcccacagcgccgccttcttcatggcggaaaagggcatttttgacaccacgccatcggcacgcgcctgctcctccagccgctgcggattaaaggattgcagcatcgccgcaataatggcgcggataccggcaatcatccccagctggtgggcctgcaaatcgaccagggcatcgcgtaccgcctgttccggcggcataaacccgggcatctggctctggtacatctgcatcagcacggttttgccggagggcaggatcttgaacgggttgttggcctcattcaggatcatcgtcatgtccgctttgacaccacgcttgagaatggatcgcgaagagagcagcgcgacggtgccctgggaaaagaggctcagcatccggccagtaatgcgcatctgctcttcatccaccggcgtggcgtgaccgttgctcagccccatcccctccagcagtgcggcgatcagccgatcctgatccaccggctgcgccggctgcgcccgacgcggctcgctggcctgggggtcgatagccagtcgcgcatcgttgtggcgctcgtggcgtgagggcgtgacctcactgaccagcagccggtcctcaacctcatgatgttcgtggatgcccagcggatttgcgggctgagcgctgtcgccagcaaacagcgccagcggatcgctctgcgtgtcgtggcaggcggggtctcgtacttccagcgcatagtcaccgatgcgcagcgcatcgccatgcttcagcacgacctgcatgccgcgacccagggtaatgccgttatgctccaccggggtcacgctgccctggttcgtcagacggcactccccgtcatgcgacaggtgaaccagcgcctgcagacgcgaaatggcccgagtctcatctggcagcaccagatcgttgtcctgactgcggccaatggtgccgccaggcggttgaaacgcgacgcttctgaccggaacatccgtagtgcattgcacaatggtaaattgcatgagttatcccagattgaacggcaaacgcttccggcctcactcgaacatgggaggatagaggccattacgtcccggctgtgaacctgccgccgggttaaacagtaacgaaaacagttgcgcggtgaggttgccgctgtgcttgtgggtcgcgtgggcaaaaccatcactgcgattactccaccagtagctcatatgctgctgaggatcgaaacgttcagccacttcacgccagctcagcgtgcagggcagatcctgaaaaccgatcacatccatgatttcagagggcttcctggccgggaccagcagcggtggcaaagcctgtatctgctgctctaactgctcgccgttcagcggtgtttgaaccgcccgtaacagtgtcgcgcccagatcctgaaaccagtcaccggaaatggtcagctgagcaggatgccactgagccagcgtgaagctgtgcagggccagcagcggccaggcgcgtccgacgcggtcacaggagggcagcagacagcccatctgtatctgcggccgggtcgcggtaaccggcagcacaaagttccacaccggcgcgtggagaaagtccgcactgtaggaatacgcctgctgatgccagtgcattaatccctgctggaaccagtgattccacggactaatctgttgctcgctcagtcgatggtgcagaaagtcaccggtcgacggcagcttgccataccagccgggggccgtataagcagccatgttcacctcaccattactcgctatgcgagtttgattgcggggccgggtgccgcggcgctaccgccagcatgccgcccgcctggtccgcaattttcagattctctgcaagcttgcgcatcatcagtgcattatcacgtgcataaggcgacgactgaatctgctgatccagcagctggctcaggtgccagtcaagctgctgcaggtcgcgggcgcttaccgtatcgggcagggagcgctgtaaattttgcagcagccaggcccgtaaaaactcgccatcataattacgcggttgatagagcatctgataggcgcgcagcgcattgcggctgtaggcgttatcatcacccgggtcgttgcgcaggatattcgtgatctgctgcgccacacgcggcagcaacaaagacttaagcgcattttgataaagcacccaggcagcatcgctaatctgattaccccggtataagcccgcccgcatagtaagcggcggattatcgagggaaaagcgcgccgagagcggcaacttcaccaggttattcagaaagggtagcagatcaaaaatattatcagcaggctgatgaatcacctgctgactttgctcacggataagtggtacccgcgcggcaacctgctgcagatactgttgattctggtagtaactgatgccccacaggctggaggcgatcagcagggcgcctgccagcacgccgtagccaatccagtggaacagctgattacggtactcccagcggcgattactgccggccaggccgctctctttgaatatcagatcgctgagcaggtcacgaataaagaagctctggcctttgttgccgggaatcggactgttgcgattaacgctgtcccaggccgcgatcgagtgatcgcccgcctgacgcaactgcagtttgcggctcagttcacccatcacccgatcaaacggcaggccttcctgggtgccgctggtgaagaagaggccgcgcgggctccaggcgaccgcatcctgatggtcagaaaaaacgatatccagatattcgttcagcagtggacgcagcgaggcgaactcctgcgggaagaggaagcactcagcgcgctcgttcaggtcgcgctcatgggtcatctgctccgccagttgttgctggagctgctgttccagccgctgaaactgctggccaaaatggcgatgccagtcatctttgtgcggcttgcccagctcccagttgaacgtgaagccccagatagcgtcacgccgcgctttatcaatcgagccgaagtagctcataaagcctttcagcagatcggttttggtgaccatcacataaaccgggaagtgaataccggtctgctgatgcagtttctgccatgcgctcacgcagcgcgctggcctgggcgaaacgcgcctcggctgagtcactcagcagatcggcgacgctgatggtcatgatcacaccgttaatcggctggcgggtacgatagcgtttcagcaggttgataaagctgtgccattccgcggcatctcgcacgcgctggctctcctgcaacgcataacgaccggcggtatcaatcagcaccgcgctgtcagtaaaccaccagtcacagttgcgggtacccccgacaccgcggaccgcatttttgcccagcgtatcggtcagcgggaaatcgaggccggcattaaacagtgcggtggttttaccagcgccgggcgcacccatgaccaggtaccagggcagctgatagagataattagcgttaaagcgtgagagcaggttcccgctgtgacgacggccaaactgggtgcgtttcagctgcatcgcagcttcgctgaagcgctggttgagccgctcttcggtcatctgacgttccgccgggtcgtcgttgcccgacagctgaagctgggtcagtaagcggctgttgaaccaggcacgatagagcgacgggatcagttggaacaggatccagagaaaatagagagcgctcacggtaagctggcgaggcagtacgggttccagggggcgcgattcgccccatgaccagaacggtcccagcatccagaccaggcagctcagcgccgtgacgccaataaagctccacagcaggcgatgcgttagcagcaggcgaagggaggcgcgcattattgtgctccttgatgattactgagcgtttcaggcgcggcaaacagggtgatttcaacgcggcggttgcgggtgcggttttcgctgctgtcgttgggcagcagcggatcgctgtcgccgcggccttcagagcgaaccgtatgaccgtcagccagttgcagttgtaacaactgggtgatggcgcgggcgcgggcaaatgagaactcatagctggaggcaaagcggctgttatccaccggatgatcatcggtaaacaccgacaccagaatggtccctttgacatctttcatcgcggttgagacgcgggccagcagggcgcgccccaccggattgatcaccgtgccctgttcggcgaacagtttgtccgcggggatgatcactttgctgccaaaggcaccatcgctgacctcaagctgcccggctgcaatcacatcattcaggcgctgacgcagatcgagcagcgcctgcggggaagagggacgacggcccgcggtaatctgcggcagcggcgtctgatagatggtacgcagcagcggttcggcggcattaccgagacgccagttcaggccgctgtagatcaggcagccgaccagcgcgaccagcatggcacaggcccagagcggcaccatcgggcgggcgagggtgctcactagcggatgcacttcaaccagtggcggttgcgctgtctggcgctgtgcgcgcgtttcgtcaatcagggttttcaggcgtttacggataccatcgcactgggcgcgaccattttcactgccgcgatagcggccttcatagcctagcagcagacagtattgcaccacttccagcagccagaggtgttgttgcgggctttgtgaaatgcgcgacagcagttgaaagaatttttcgccgccccagctttcattatggaaggtcaccagcatgccattgccagaccagacgccgcgcgtgccccatggggtttgcgccgccgcttcatcgagcgcgctgcagatgcagtaacgcgcgccgataatcatttcaaacggcagccctgcctgtttacagcgttgttcaaactggcggatttcatcgatcagagactggcgcagacccgcagggtcatcatgggtggctgcctgacgaatttgcaccaccgcgtttcagcagtggcgccgcagcctgaagtaagagattctcattgcctgagggggtcgcctcacgcgcaggggattccacagtcattaattcgtgatcttccagccaatggcaaatccctgtacccgcagcccgggacggttctgcgggcaatatgcgccggatttcatattcagtctaagatccaggtcgcggtatcgttagtccggcaggctttgctggcgccgccgacggccacacagacctgtttagttttgcggggacggggacgatcgctctgcacggtggcatcgtaacggctgctctctacacccgcttttaatggcacataaccgatcagcgggccgtcagcctggtcagcaatcgccagccagctgtgttccacattacctaatacttcgaacggtttacccgtttcgagatagcgaaccactttgccgccgtaatcaggcgaggtcatgacggatgcgccataaagcgcccgccaggtctgattgaccggctcaaattcagtcggtgccgcgacagcgtgtcgatggaccagtttgacgccgttaatttcgctggtaaccagcgtatcgtcagtgacgggcggcggcggggccttacagcctgccagggtaagaaccgccagcagcgttaacgcaagactctttttcaccatgttcctcgtgatctcatcaaagtatctgcatattgccaggcccgatgccatggggcgatctttatcgcgccgcatcgtgccgaaattctgtttttaaaaaaagggtcagattacatcgggatagtaacgcattcagtttacctaagacttttgagaattcaaaccattgcacccgctgctgatgcgtgatagcaggcgctttacgggcgggtttcggtataagaaaagcgccaggtaatgtgatagttaaagcgaactgaattatcgcagagacaaactggttgagaacagtgccgcgcattctgacatgcaatgaatccgattggaaactattaagatttactaataacttgttgccgaaaaaatttatcagtttgcgttaagaaacttatcaaaatcagattttacgcccctgctcagaccctcttttttcaggaaagcggcacgccttttgcttctgaaaggttttaaccgcactgaggtgagcaatgagggacgccctgacctggctgcaggcatcacgcgcgagcgatatcgccagcctgcaacgtcttctggaaaccggcgagctgatggctgccgtcagtgaactggtccatcggttgcagcgggaacgtggcgcaaacaatctctggatctgctctgacggagcgctgttcagcgccgaacgtcatgcccgccagcaggaggtcagcgccggcctggagcatttttatcaggcgctgccggccgccatagcgcagcccggctacagccgcttctgcaacctgattgccgctgccctgcaggcgctggccggactgcctgcgctgcgccagcaaatcagccagcgtgagcttgatcaggccgcggcgatggccgcctttaaccaggttatccgtactttactcaatctggtgtttgaggcggccgacaccgccagctatcccggcatctcccgtgcactgatcgccctgttcagttttatgcagggcaaagaactggccgggcaggagcgggccatcggctcagccggctttgcggcgcgtcagttcacccccgaccagcgcagccagatggtcgccctgattgcggcacaggagcagagctttatcaccttccgggagtttgctgacagcgccgcgtgtgaatcctggcagccgctggctcaggccagccgcgacatcgaacgccttcgtcgcatcgcctgcaccggcggccgttgtgatgagaccggcgcgctgcactggttttccctgctctctgagcggctggatcagatgaaaatgctggaggatgccctgacggcgacattgatgcagcgctgccgggctgccattgatcaggcacaacagcaggcggcaggaacagtggtgcagggcgacagcaatttttcgctttacgtctccggggcggactggctgcctggcgcggcggcgctcgacagcgacggtctggccccgcagctggggcgctcggtgctatcgctgattggcgaacagtcgcagcgtttgcagcagcaggcggatgaactggcggcgatgcgcgcctcactggacgagcggcgggtgatcgatcaggccaaacactggctgatgcagcagcagggtttcacagaagaggccgcctggcaggcattacgcaaaagtgcgatgaatcagaataagcgggtactggagatcgcgcaggcggtactggcggtagcgaagaccctgagcaactaacccggatgaggtagctgcacaacctttgtgcgtgatctgcgtcagaaacgtgcaaaaacggttaatttttcaacagtgcgtcaccgcagatcggcattaaggctgtttcggcgatctggcacatcctttgcttaatccctatagagagtacgcattgctcccgccaatggcggtggggtcagtgctttggataaaggcgtccatccgcaggcttcggcttgtcggaggacgcctttttttatttctgttcaggggcaacaagatgagcaaaacgccattttcactgacacgacgtcaggcgctgatctccggcgccgcgctgggtgcggcctggatcgttccgggattacgaaatgcggtctgggcagcgggatcagatgcgccagaaaaagcgcaggtgcgggtcggctttatcccgctcactgactgcgcgccggtggtgatggcctctgtgaaaggcttcgacaaaaagtatggtctcacattgcaggtcagcaaagaggcgagctgggcggcggtgcgcgacaaactgacctccggtgagctggatgcggcgcatgtgctctacggcatgatctacgccctgcaactgggcgtagcgggtccgcagcacgacatggcgaacctgatgacgctcaaccataacggccaggcgatcaccctgtcgaaccagctgaaagccagtggggtcaccgatgcggccagcctgaaaaaggccattgatggcagcgccaaaggcagctttaccttcgcccatacctttccgaccagcacccatgccatgtggctctattactggctcgccaatgcgggcatccacccgtttgatgacgtgcgcaccgtggtcgtgccgccgccgcagatggtgatgaacatgaaaattggcaacatgagcggcttctgcgttggtgagccgtggaaccagcgcgccatcagcgacaacatcggttttaccgccgccaccagccagcagatctggccggagcatccggaaaaagtgctcggcacccgcgcagagtggatgaaagagaaccccaacacggcccgtgcactcaccgccgctgtgctggaggccgcgcgctggattgatgcctcggacgacaaccgccgcgaaaccgcgcaggtgttagccggccgcgcctggatcaataccaaagtggagacgttacagggtcggatgctcggtcagtatcagaacggcctggggcagtcgtggcaggacgctcacccgatgcgcttctttgacaacggcaacgtcagttttccctggctctcagacggcatgtggttcctgacccagatgaaacgctggggcctgcttgccagcgatcccgactacctcgcggtggcgcgccagatcaaccgcatcgacatctacaaacaggccgccagcgcagtcggacaggttgcactgcccgccagtgaaatgcgcagcagtaccttcatcgacggcaaggtctgggatggcagcgatcctgccgcctatgccgccagtttcgctatcaaacgttaagagaggttgctatgaaaactgacgcgcgcgccctggcgcagccggtgcagagtcacaacagtgccaccgttattccgttacaggtcaccccgaaagccgcagcccgtccggcgcgtctgcgtccgctgttgcagcgcgccattcccgccaccggtggcctgttattaatgctgctggtgtggcagatcgcggcgctgtcgcaaccgggtttcccttcgccttacgccacctggcaggccgctcaggtcctgttcgctgacccgtttctacagcaacggccccaacgatcagggcatcggctggaacgtgctggcgtcgctgcaacgcgtcggcattggattcggcctggccacgctggtcggcattccggcgggctttttaatcggtcgctttagctttatggcgcagatgttcaatcccgtcatcgccctgctgcggccggtgagtccgctggcctggctgccgattggcctgctgctgtttcagcgcgccgagcctgccgccagctggaccatttttatctgttcgatctggccaatgatcattaacaccgccgaaggggtacagcgtattccgcaggattacctcaacgtggcgcgggtgttacagctttctgagtggacggtgatgcgccggatcctgctgcccgccgtgctgcccgcggtgctgaccggggtccgtctctctatcggcatcgcctggctggtgatcgtcgccgccgaaatgctgaccggcggactgggcatcggcttctggatctggaatgagtggaacaacctcaacgtggaaaatattctggtcgccattctggtcatcggcgtaatcgggctgctgctggaacaggggctgatgctgctggtccgtcgttttagctgggataaataaggagagcacgatgcaacagatcattcgcgtccagcaggtcagccagcgttttgccaccgccagcggcgagtttctggcgctggacaatgtcagttttgatattcacgaaggggaaaccctgagcctgatcggccactccggctgcggcaaatcgacgctgctgaacctgattgccggtttaacccggcccagcagcggcgtgctgctgtgtgataaccgcgaaatcactggccccggtccggagcgcgcggtggtgtttcagaaccattcgctgctgccgtggctgacggcatttcagaatgtcgagctggcggtgcaacaggtgtttaaagggcgcttcagcaaagcggagatgcgtgactggatcgagcacaaccttaaccgggtgcagatgagccatgccatgcacaagcggcccggcgaaatatccggcggtatgaagcaacgcgtcggtattgcgcgggcgctggcgatgaagccacgcgtgctgctgctggatgagccgtttggcgcgctggacgccttaacccgcgctcatctgcaggacagcgtgatgcgcattcagcaggagctgaacaccaccatcgtgctgattacccatgacgtggatgaagccgtgctgctgtcagaccgggtgctgatgatgactaacggcccggcggcgcaggttggcgagatcctcactgtcgatctgccacgtccgcgttcacgggtggcgctggcggatgagccgcgctaccaccagttgcgacagaaagtgctgcatttcctctatgaaaaacagaccactgcggcgtaaggaacagaccatgaagcaacggttgctggtgataggtaatggcatggcgggaatgcagatggtggagagcctgctgcaacgtgcaccgcagcgcttcgccatcacggtcattggccgcgagccgcacggcaattacaaccgtgtgctgctctcgccggtgctggcgggtgaaacgccgttcagtgaaacgctgatccacgatcgcgactggtatgagcggcacggcgtcacgctgctatccggcgaaaccgtgctgcaggtcgatctgtcggcacgtacagtgcagaccgattatcgccagctgggctgggatcggctggtgtttgccaccggttcacagccccgtttgcccgccattcccggcatcaacgcggattgcgtactgggttttcgcagtatcgccgacgtccggcaactcctggcgtgccagggaccggtggtggtgttgggcggtggttttctcggcattgaagcggcggcggcactctgtgcccgtgggcgtgaggttacgctggttcatcacaaaccctggctgctggatcgccagctggatgcaaaggcgggcgagctgttgctgacggcactccagcagcgcggtatccgctgcgtgctgaacagcggactcacggcgattgacgaggcgggtgtgacgctgaccagcggtcgtcactgcgccgccacgcaggtggtgattgccatcggcgttcagccggagataacgctggcgcaggcagcgggtctgccgtgtcagcgcggcattctggtcgatgggcagttacgcacagcggtcccgtcggtgtacgccgtaggcgagtgctgcgaaattgccggcgaaacctttggcctggtcgcaccctgcctgacgcaggcgcagattctggccgcacagctggcggggtcgccactggcggattttgtcagccagccgcaggcgacgcggctcaaagtcagtggcatttcgctgttcagcgccggggatgtcagtgaggcaccctccatcagcagttttgatccgatctccggcgactaccgccgtctgtttcttcgtcagggccgcctctgtggcgtattgctctctggcgacacccggcagggtcccgcgctgctggcgcgtctgctgcacaccgaagctgtcacgctcgaagccctgttcgattcccgtcaacctgaaccgcagccgcaggctgcagagagtcctgagatgagtaaaccggtattagccgtggtgggtcacggcatggtcagtcaccactttcttgaacagctggttgcccgcgaactgcatcagcactaccacatcgtggtttacggcgaggagcgtcagcaggcttacgatcgggtgcatctgtcggactatttcaacggcaaaacggccgacgatctgtcgctggtcagcgcggacttttttaccctgcacggcatcgaactgcgcagcggctgcgcagtcgtagcgatcgatcgtcagcagcgcagtctgcgtgacagcgcgggcaatgagctggcgtgggataagctggtgctggctaccggctcgcgtgcttttgtaccgccggtaccgggccacgacgacgaacgctgctttgtctaccgcacgctggatgaccttgatgccattgctgcctgcgcccgcaatagccagcgcggcatcgtgattggcggcggcctgctgggtctggaggcggcgaatgcgctgcagcagctcgggctggaaacgcatgtggtggagtttgcgccacgcctgatggcagtgcagctcgatgagggcggggcgctgatgctgcgccagaagatcgatgcgctgggcgtcacggttcacacctcaaaacagaccgaactgattgagcgtcagaccgacggtagcgtggtgctgcgctttgctgacggcagcagtttacccggcgatctggtgctgttctccgccggtatccggccgcgcgatgagctggcacgtgaagcgggcctgacgctgggaccgcgcggcggcattgagattaacgatcgctgccagaccagcgatgaagaggtgtttgccattggtgaatgcgcattgtggaacggtcagatcttcggtctggtcgcgccaggctatcagatggcacgcgtgctggccgggcatctggcggctgaatccaccgccttcagcggcgcggacatgagtaccagactgaaactgctgggggtggaggtggcgtcgtttggtgacgcgcatggccgcacgccgggcagtcagcactatcactggaccgacgggccaaaaggcatctacaagaaaatcgtggtttctgccgacagcacccggctgctgggcggcgtgctggtcggtgacagcagcgactacgccacgctgctgcagatgatgctcaatgagttaccgctgcctgccgcgccagaaagccttatcctgcctgcgctgtcgggggcgccgaaagcgccaggcgtcgcggcgttgcctgacagcgcccaggtctgctcctgtcacaacgtcagcaagggcgaaatctgcgcggcggtgaaaggcggatgcggtgagatgagcagcatcaaaagctgcaccaaagcggctacgggctgcggcggctgtgcggcactggtaaaacaggtgatggagtttgagctggaaaacctcggtgtcgaggtaaaaaaagatatctgtgaacatttcagctattcgcgccaggaactttatcacctggtgcgggccggtgagttcagaacctttgatgcgctgctgacgtcacatggtcgggggcagggttgtgaagtgtgcaaaccgctggtggcgtcactgctcgcctcatgctggaacgactatctgctaaaaccggcgcatctgccgttgcaggacaccaacgaccgctatttcgccaatatccagaaagatggcacctattcggtggtgccgcgcgtcccggcgggcgaaatcacgccgcaggggttgatcgcgattggcgaggtggcggcgcgttacgatctttacaccaaaatcaccggcggtcagcgtatcgacctgtttggcgcgcggctcgatcaactgcctgatatctggcagacgctactggcggcgggttttgaaaccggtcacgcctacggcaagtcgctgcgcactgtgaagtcctgtgtggggtcgacctggtgccgctacggcgtgcaggattcaaccgctttcgccattgcgctggagaaaccgctacaaggggctgcgcgccccacacaagatcaagatggcggtatcgggctgtacccgcgaatgtgcggaagcgcagagcaaagatatcggggtgatcgccacggaaaagggctggaatctctatgtgtgtggcaatggcggcatgaagccgcgccacgccgacctgttcgccagcgatctcgatgatgccacgctgctgcgttatgtcgaccgcctgctgatgttctatatccgcaccgcagacaggctgcagcgcaccagcgtctggatggacaatctggaaggcggcctggactatctgcgtcaggtggtgattgaggatagcctcggtctgggcgagacgctggagcaggagatgcagcgggtggtggacgcgtatcagtgcgagtggcagaccacgctggcggatccttcacgacttgcgctgtttacccctacggtcaacagcgatcgcccggatgagacgctgcactacagccgggtgcgcggtcagcgtcagccggaggccgttaccgatcgtccgctgttaccgccgccagccgagccgtggagcgcggtgtgtacactggaggcgattcctcagcaggcggggatcggggcgcgactgggtagcgaacgtgttgcgctgttccgctttggcgatgcgctttttgcgctggaagaccgcgaacccggcagcgacgccagcgtgctctcacgtgggatccttggcgatgtgggcggcgagccggtggtgatctccccgctctataagcagcggatacggttgcgtgacggacagagcctggataacccgcagcatcagctgcgctgctggccggtgaagttggaagcgggtcagatctggctggcaaatcgtccgctggatcagctggcgcaggcatcatgaacagtacctgtccctattgcggcgtcggctgtggcgtctgcgtcaccccgcagggggcgcatcaggcaaccgtgatcggcgatccgcaccatcccgcgaatgcaggtcggttgtgcgtaaaaggcgcagcgctgggccagaccctgacgccgcaagggcgtttgctgaacgccgaggttaacgggcagcgcgtcagcctggacgctgcgctggatgcggcggcggcgggattgcgggcggttatcgatcagtatggcccgcaggcggtggcgttttacggctccggccagctgttgaccgaggattactacgtcgccaataagctgatgaagggctacatcggtgcagccaacatcgatacgaattcgcggctctgcatggcgtcggcggtggtcggttataagcgggcgctgggggccgatgcggtgccctgctgctatgaggatctggagcaggccgacctggtgctactggtggggtctaatgctgcctgggcgcatccggtggtgtggcagcggctgatgcaggcgaagctgcaacgtccggcgatgtgtattgtcgttatcgatccgcggcgtacggcgagttgcgatcaggccgatctccacctgccgttgcggcccggcagcgatacggcgttgttttccggtctgctgcactggctggcgcagcaggatggcattgatgccagcatgttgccgcacctgaatggtgtggacgagacgctgaccgccgcagcgcagtggggtgtggcgcgagtggcagaggcatgtgacttaaccgtgcagcaggtcgcgcactttttccagcttttcagccagcacgatcgggtgctgacgctatggtgcatggggattaatcagtccgccaccggcagcgacaataaccaagcgattcttaatctgcatctgctgacgggcaaaataggccgcgcgggctgtggtcctttttcgctgaccggacagccaaatgccatgggcggacgggaggtgggtggcctggcgaatcagctggcggcgcatatgaattttactgaagcggattgcgaacgggtgcagcgtttctggcgcagtccggccattgcccgggaaccgggactgactgcactggatcttttccgggcactggcggatggcacggtgaaagcagtgtggattatgggcaccaatccggcggtgtcgatgcctgagggcaaccgcgtcgcgcaggcgctggcggcctgtccgctggtgattgtatcagatgtgatggcgcagaccgataccagcgcctttgccaatattctgctgcccgcccaggggtggggcgagaagaacggcacggtgaccaattccgagcggcgtatttcacgtcagcgcgcttttgccgccgcacccggtgacgcccggcctgactggtggttgctgtcgcaggtggccaggcgtttagggtttgatgaaggctttaactggcagcatccggcagagattttccgtgagcatgcggcgttgtcaggtttcgagaaccggggcgccagggcgtttgatatcagcggcctggcgcaattgagtaatgctgactgggatgcgctgcgtccggtgcagtggccggttaacgcggcctgtccgcagggctgcgcccggctgtttggcaatcgtcggttttttcatccggatggtaaggcccggttgcgggtgccggccacgccggttgtcgccccgcgcgaaccggcgtatccgttgttgatgaataccggacgggtgcgcgatcagtggcacaccatgacgcgtaccgggctggtgccgcgtctgatgcagcattgcgatgaaccgtttgtcgcgctgcatccggcggatgcggcaacgtatggcgtgacggcgggcggactggcgcgggtgcagtctgttcagggctggattagcgtgcgggtgcgtgtcgatgccgggatgcggcgcggcgagctgtttgtgccgatgcactggaaccggcagttcagtcagcagagtcacgtcgatttactggtggccgcccgcgcctgtccgttttcggggcagcccgcgctgaagcagacgtcggtgcggattctgccgttgagggtgagctggcagggctggctatggcagcgcgagatagcgcagcccacagggttgcgttactgggcgcgtaccccctatccggcggtgcagcgttatgcggtggcgggcgagggctcgccgcaggtctggctggacgggcaggttgttctttcaggctgtcacaggcaggttgcgaccggcagcggcaatgattaccggttgctggcatggcgtgacggcgagttgcagctggcgttttatgccggctccgtgttgccgtcgattgatagtgcgtgggtcgccgaggcctttagtcatgcgccgcaggatgcggcagggcggcacagtgtactggcaggacagcccgcgcagggcgcggccacgggacggattatttgcagttgtagggcggtgggtgagcagacgattttacaggcggtggcgcaggggtgtcgtacaactcaggcgttgggcgaaaagctaaagtgcggcacgcagtgcggctcctgtattccggagctgaagcagttgttgctgtccgaagtgatgtcggaggaatgatgacacgagcaattgattctctggataagttactggccccggtggatgccgtgtcgcaacagggcgcggtgtggctggtgggtgcgggccctggcgatgtggaactgctgaccgttaaggcgttgcggttgctgcagcgtgctgaggtggtggtatatgaccggctggtgagtgacgcggtgatggcggaggtgccggagcaggcgttgtgtattgatgtgggtaagcagccggggcagcatggtctgaagcaggcgcagattaatcagttgctggtggaactggcgcgcagtggacgcaatgtaatccggctgaaggggggcgatccgtttgtttttggtcgcggaggcgaggagatggtgagcgtgcagcaggccgggattcgctgtgaggtcgtgccagggattacggcggctgtgggctgtgcggcagccagcggaattccgttgacgcatcgggattgcgcgcagtctttgcggttgattaccgggcatgggcggaacggcgagccgcagctggaggcggctgcgctgacggcggtgaatcagacgctggtgttttatatggggttgagctggagtgcgtcgatcagtgcgcagttgcaggcgcagggacgtgatgcggagatgccggtggcgattattgagaatgggacccggcccgatcagcgggtgttgattaccacgctggggggattagcggagacggtggcgcgggataagccggtgtctccgtcgttgctgatggtgggtgaagtggtgcggttttatcgggcggatttgcaggtgcggggtggggagacggtgagccggtgcgtcgtgcaggaaagacctgcctgatcgcaaagggatcccgcatccctgcggactgagctcgccatccctggctcgcacactttgctcttcaggcagggcttacctgcactgttggcattggtgcggggttttgcgggatcaggtctggattgagtgggcgtatgtcttggtggtaaggccggaacggtgcggcaagacggtgcggcaagacggtgcggcgtgcaggaaaggcctgcctgatcgcaaagggatcacgcatccctgcagactgggctcgccatccctggctcgcacactttgctcttcaggcaggcccttcctgcccggctggcggcggtgcggttttttttgggatcagatctggattgagtgcggttgatgagagtggaagtgcccgagcaggacgaaaagagcagtccagtgtgggaaggcaggtgagggttggtaagacggtgcgtcgtgcaggaaaggcctgcctgatcgcaaagggatcccgcatccctgcggactgggctcgccatccctggctcgcacactttgctcttcaggcaggccttacctgcacgattagcgatagtgcgtgcttacagtggaggcaccatcgtgcaggtgcactgtataaaagacgatggagctttagctggctttaaagctcctcccacacaggcaggttgtgaaccttttttcgatatgcgtgaaacagtgccattgtcgtaccgaagaacagacctgcgatcagattgggtatcagcgaatagttgtcgtcagacacgcccggaagagaaggcaataagagcagcagtggcatcataagcgtgtacatgctggcaaacaccacaagattgagccagaaaggagtgaaactcgggggtggaagatggatattcattttccataacaaacgatgtaatggcggagcagagtgactcggccatattttcttcgctgccatcagggctaaagcccgcgctttcctgcgctcgaaaatctcgtttttcatcgttttatcatccgttacatccctgcttagcattcgctctggagcgtaacttaatcctgtggctgtctgatgacaacgagtggctgaatcgatgttgtttcaacaagcattacatcgcccgcttcagcggcagcggggccactagcactttcacgcctagtgcttcaaacgctttgacctgcgcagtgctgatgccgctgtcggtgatcaggtagtgaatattgctccagtcacagggcagcgcgaacatcgaaaccttgtcgattttgctggagtcagcgaccacgtaaaccgtgctggcggatttgatcatcgccagctttaccttaatgtcggtttcactggggaagctcaggcccagacgtggcgagatgcaggcggtcgccaggaagagtttaccggccagcacgttttcgaagaagctggccgccttttcgccggaggtagagagcgtcggaaatttaaaggtaccgccggtcagcaggatgttgatccccggctcgccgcccagtttcagggcgatattcaccgcggttgtcacgaccgacaggcggcggatgtggctgatggcatcggtgatcgcggtggtcgtggtgccggaatcgaaaatcaccgtgtcgccattttcgatatgctgcgccgccagccggccaatcgcctctttctcttccagatgcgtctgccgctccagcagcatcgccccggtattctgtttgcccgtcatcagcgtcgcgccaccatggtagcgctgcacaaagccctgtttttgcagcatgcgaaggtcgctgcgtaaggtggcttcggtcagtccaaaggtctccgtcaaagctttaaccgtgaccgtgccatcctcacggatcatctccagaattttctcgcggcgttgctgcatgtcagcgaactgctcacttttgcttttcaatcgaaatgctcccttttccaataacctgagaagtcgggcgaacaaggtctttgtggctgagtttaacgcgccatttttatgaatgcgagatagcctgatctgcctttggttttcgaacgaaaatataaaatgtgcaggttattgaatctctcacgctttccggattacaaccagctgcctttatttcgggactggaagccagatcacgtcttttcaatcagataagccgctttgcagggcagatggtcgaaatttgatctgctccacacaacatttcttttcgatagcttatatttttgttcgaaaatgagtgagtcaacggcatcggcaaaaatctgaggggaagagtgggatgagtggtgaatatgacgtaaacctgcgctacggcgtggataccgcaatgaatctggctggcaaagtggccgtcgtaaccggcgggctgggcggtatcgcgatggcgaccaatggcatgttgctggagaagggagcgagtctggcactactctatccgccgtttgaagcagagaaggtggccagcctgagggcagatttccccgtcgagcgggtgcagtttgtctgctgtgacgttaccgatcctgcgtcggttgaacaggcttttgacgatgtggtttcccactatggccggatcgatatcctggtgaactgcgcaggctacgtgatgctgcagccggtgatcgaaaccgattttgacgagtggcagaagcagattgcggtgaatctcaccgggccttttctctgctcacaggccgccgcacggctgatgatccgtgccggtgcgggcggcaaaattattaatatcgcctcccaggcggcatccatcgctatcgacaaccatgtcgcctatacctcagccaaagcgggcctgctgggcatgaccaaagtgatggccaaagagtttgccccgcatcgcattaacgttaacaccctgtcgcccaccgtggtgctgacgccgatgggcgaaaaggcctggcgcggcgagaagggcgagcagatgaagaagctgattccgctcggacgctttgcctataccgatgagatcgccgctgcggtgctgtttttcgccagcaacggcagcgacatgatcactggcgccgatttgatgatcgatgggggctttaccatctggtaaggccaatccagcacccgggaattcataccctgccataacgataagagagaacatcatgaaaaaccgtaccttgctgtgcactgccgtggctgcctgtctggtttcgcaggcggcgtttgccgccgaaaagggcaccattatgattctggttaactcactcgataatccctactacgcctccgaagccaaaggcgccaatctcaaagcgcaggagctgggttacaaaacgacagtgctgtcgcacggcgaagatgtgaaaaagcagagcgaactgatcgacgccgctatcggtaaaaaagtgcagggtatcgtgctggataacgccgactccaccgccagcgtggcggcgattaaaaaagccaaagatgccgggatcccggtggtgctgatcaaccgcgaaatcccggtggatgacgtggcgctggcgcagatcacccacaacaacttccaggcgggttcagacgttgccaacgtctttgttgaaaagatgggcgaaaagggcaaatacgccgagctcgcctgtaacctggcggataacaactgcgtgacacgctcgaaatcgttccatcaggtgctggatcagtatcctgatatgcagagcgtggcacgtcaggatgccaaaggcacgctgatcgacggcaagcgcattatggacagcatcctgcaggcgcatccggatgtgaaaggggtgatctgcggtaacggcccggtggcgctgggcgccattgctgcgctgaaggcagccggtcgcaacgatgtcatcgtggtggggattgatggcagcaacgacgaaacgcgatgcagtgaaagcgggcacgctgaaagccactgtcatgttgcaggcgcaggcgattgccgctgaaggggtgaccgatctcgataacttcattcagaagggcgtgaagccggaaaaacagcgggtgatgttccgcggcattctgattaccccggaaaacgctaaaggtgtacaggactttaactacaagtcgtaattaaacgctgtcgcgcctgcgaaagcgggcgccagggagaagatgatgtcccgaagagtctggctgacgctggtggtcttgctgttaagcggctgcaaaattgtgtcgcagcaggagctggctgccctgaaaaatccccccaatccgaaaatggcgaacatcgaccagctctggcagcagaaactggtgccacaggttcaggcagaggctaaaccgctggcgacgctgatgaagtcgctgcagtctgctaaagacttcgacagtgcctgtcagagctacggctatcgcagtcaggctgagaatccctgtgtcttcagcgtctcggttagcggcgaggtgaccgccgtaaataccacgtcacgcagtggaaagatgaccgtgaaagatgaatcaggtgacagtgtcacaattcaggtcgggccaatcattcgtggcaccgctttgcgggatgtctacaaaggcgtgagctatcaggacttcaatgaccaggtgctgtttggtgattacggcaaggcgattaaccagcacgcctccactctgatgcagcagtttgcgccgaaggtgggcgataaagtgagggtttccggcgtgttcagcagctgggacattccgcagcagctgccggatatcactccggctgcgatcaaccggcaataaggagcggcagatgcaaaatcctcaaccgcaacagtccggcgacgtgattatcgaaacgcgcaacgtgtcgcgtctttatcccggcgtgaccgcgctcgatcaggtcagttatcgggtctaccgcaataaagttaacgtgctgatcggtgagaacggcgccggtaagtccaccatgatgaagatgctggcgggtgtagagacgccgtcgtcgggcgagattctgctggatggcaaggtggtgtcgctgaactccacgcatcaggcagagaagcaggggatcagcatcatttttcaggagctgaatctgtttcccaacatgaacgtgatggacaacatctttatcgccaatgagtatttccagcgcggggtgatcaatgaaaagtatcagtacgcgctggcaaagtcgctgctggagcggctgcagctggatgtcgatccttacgcgccgctgggtgagctgggtattggccatcagcagctggtggagatcgcccgggcgctgtcgaaggatacccgggtgctgatcatggatgaaccgaccagcgccctgagccagtctgaagtgaaagtgctgtttaacgtcatcgatcagcttaagcgacgcggtgtcaccattatctacatctctcaccggctggaagagctgatggagattggcgatcacatcaccattttccgcgatggccgttttatcagtgagcgcgaggtacgggacgccagcgtgccgtggattatcgcccagatggtgggtgacaagaaaaagcagttcgactatcagcctgcgacacagggggaaacggtgctggaggtagagggcctgaccgcgctgcatcagaacggcggttacaagctgaatgaggtcagctttacgctgcgcaaaggcgaggtgatcggcatttatggcctgctgggggccggacgcaccgagctgttcaaggggctgattggcctgatgccctgtcagtcgggccgggtacgtttagcgggcagggatctggcgaaacgcagcttccagcagcggctgaaaagtggcatagcgctggtgcccgaagatcgcaaaggcgaaggggtgattgaactgatgtcggtcaccgccaacatgacgctctctgacttcagcctgcgcggttttcgacgtgcgctggggctgttaaatcctgccagggagcagcagcgggtcagtgagatgatcggccatctggcgattaaagtcagcgatcccgacctgccggttacggcgctgagcggcggtaatcagcagaaggtggtgctgggtaaagcgctgatgaccgggccgcaggtggtgctgctggatgagccaacgcgcggtatcgacgtgggtgccaaaaccgacgtctatcacctgattggcagtctggcacagcaggggctggcagtgatgttctcctcgtctgaactggatgaggtgatggcgctggcggaccgcattttagtgatggccgatggccggattactgccgatctgccgcgcgcagcggcgacgcgagaacatctgattgcggcatcaaccccgcaggattaagagcctgacccatcaggctattttatttgtccgtctgaacctgggcagtggtcacacaggctgctttagcaacctgaacgcccgtcagggcggccctgaaggggcgagcacagcgagtaatcctcacgtactgcgtgtacgtgccggttgttccgcgctgtccgtgtccagactgcctgaaaccattacgctggcgggccagactctaagctggccggagaatttcatgaaccaaaaatatctgctctatatgtacctgctcaaggcccgcacctttattgcgttgttgattgtggtcggctttttcagcgtgatggtgccgaactttctcaccccctctaacctgctgatcatgacgcagcacgtggcgattaccggcctgctggccattggtatgacgctggtgatcctgaccggcggtatcgatctctcggtgggcgcggtcgccgggatctgcggcatggtggcgggcgcactgctcaccaatggcatcccgttgtggggcggcaatacgctgtttctcaacgtgcctgaagtgattctggtggtggccatctttggcgtgctggtggggctgattaacggcacggtgatcacccgactgggcgtcgcaccctttatctgcaccctgggcatgatgtatgtggcgcgcggtgcggcgttgctgttcaacgacggcggcacctacgctaacctggtgggagtgcccgcgctgggcaacaccggcttttcgctgctcggctccggcaccgtactgggcgtttatctgccaatctggctgatgctcggctttttactgctcggcctctacctgacgcgcaaaaccccgctgggtcgttacatctacgccattggcggcaatgagtccgccgcgcgactggcgggtgtgccgattatcaaggtgaaagtctttgtctacgccttttccggcctatgcgcggggcttgtcgggctggtggtggcctctcagttgcagactgcgcacccgatgaccggcaacatgtttgagatggatgccattggtgccaccgtgctgggcggcacggcgctggcaggtggacgtggccgggtttccggctcgattattggcgctttcgttatcgtcttcctggcggatggcatggtgatgatgggcgtcagcgatttctggcagatggtgatcaaaggtctggtgattgtgactgcggtagtcatcgaccagttccagcaacgtctgcaaagcaaagtggtgctgctgcgtcgccatgaaaaaaagcagcaggcagccccccttactgatattcgtcacagttaacaggagcgattatgagccgcgaacaacgtggaaaaacagtggtgataaccggtgcctgtcgtggcatcggggccgggatcgcggcgcgtttcgcccgcgacggggccaggctggtgatggtgtcgaatgctgaccgggtgttcgctacagccgaccagcttcagcagcagtatggcagtgagattctggcgctgcaggtcgatatcacggatgaagctgcggttcagcagctctatcagcaggcctttgaacgctttggtcagatcgacgtctcgatacagaatgcgggtgtgatcaccatcgaccgcttcgacaccatgccgaaaagcgactttgagcggattctggcggttaacaccaccggcgtctggctttgctgccgtgaagcggcgaaatatatggtgcagcagcgcagtggcagcctgatcaacacctcatcggggcagggacgacagggctttatttacacgccgcactacgccgccagcaaaatgggggtgataggcattacccagagtctggcgctggaaactggcgccgtggaacattacggtcaacgctttttgccctggcatcattgagagtgagatgtgggactacaacgatcgcgtctggggcgagatcctcagcagcgaggagaaaacctacggtaaaggggagctgatggcggagtgggtgaaaaacattccgctgaagcgtgccggtcagccggaagatgtcgccggactggtggcgtttctggcatcagaggatgcgcgctacatcaccgggcagacaatcaatgtggatggcgggctgatcttctcctgatgcggtgagagatcgcaggcctgctgtaaacgcaggcctttttctgacccggacttttctgttatatgcacaattcgccgctgctgtcctgcatcgccgtcacaatatgttaaggtaatagctgatgatttttctttaattgcagctacgaactaatcaatgtgccgggtgacatgatacggaaaacaggggttctctctttgattgcgctgtcgctgactgccacgcagagcgcccgcgccttccagactgaaacagcggtgtcagagacgccattcgacaatcctgcgcgctacagtcagtcgctgccgacgctcggcggtgccagcgatcaggatgaagagtggagcaaaaagctggcggccgtggccaaaagtatcggtgaagcgagtaacaacagcgacagcaatgtcacgtttggtcagcaggcgggcgtctgggcgttcaatcatctgcgcgatgaagtggccgatcgggttgagagcgaagggcagtcactgctttccccttacggcaccgcgcagctggatctgaaagtcgacatgaacggaaactttaccggcaccggcggcgatctcttcagcgcactggccgacgaaaacagccggctcaccttcagccagcttggtctgcacgataccggcgatggcctggttggcaatgcaggactggggcaacgctgggatgccggtgactggctgctgggttacaacggctttgttgaccgcgtgttcagcagcggcctgcagcgcgcctctgtgggtacggaagcgtggagcgattcaatgcgcttctcggccaactactatcagccgctttccggctggaaaaatctgggcgattcgcagcagcagcgcatggcgcgcggctacgatattaccagccagagctatctgcccttttatcgtcagctgggcgtttcggtgagctatcagcaatatctgggtgagaatgtcgatctgtttaacagcggcaaccgctatcacaatccctccgccatgtcgtttggcctctcttacactcccgtgccgctggtgacgctgtccgctacccataaaaccagcagcgccggtgagagtcaggatcagctggggctgaaactcaactatcgctttggcgtggcgctgcgacgtcagctcgatgccggaaacgttgcggaggcgcactccctgcgcggcagccgttacgataccgtcacccgcagtgatacgccggtgctcgctttccgtcagcgcaaaacgctgtccgtgtttctggccacaccgccctggcagttaagcagtggcgagagtctgccgctgaagctgcaggtgcgcgccagcaatgctatcaaggcggtaagctggcagggcgatacgcaggcgctgagcctgacacctccggccaataacgccgatccgcagggctggagtgtgatcttaccgcagtgggatccgtcgccagacgccagcaacgaatatcgcctgtcggtaacactggaggatagcaagcagcagcgtgtgacctctaactggatcaccctgaaaattcagccaccgatgaccgtggacgaggccccgcagaacgatcgttatgatttgatggcacccggcggcaccacactttagttgggatgctttactgcacagaaaggataggggggagttaatagcggtggtggtgtgcagacggcgttgttaacgtctgcaggcccgacagcggttactggcagagataagttgtcgggatgacgaaggcgcggcagagtgacatcactattgatcctgaaatgagagcgggaaccactgggtgaaagcaggaacgacgctgcgcagcgggcagggtatttatattaagaaggcgcgggcagcgccgccgtttagcacagcggcccggttatcagttaaccatgctcatcacaatacgcaccgctctggcgtagacctctcgctgaccgtttaccgaccgtgcctgctgatgctgcaggaatgcaattatgtcctgtaagcctgccgtcttgcctgacttcagcaggctcgacacggcctgccctacaacggcatggacgtcagccatatctgccggtttatcggtactcaattgaaactccagcgcaaccgtttctgttgaatagcacctgaagaggtaacactcaggcgattcagctttatcagcctggtcacaggttttttataagccagcatcatggcagggccttaagcagcttttcacgcagcgttgccacctgggttgtcagctcaccgagttcactacaggcggtatccatcaccgagatcatatcagccgggacgtcagccgccgcgactttaagctggtggccctgttctgtcagggagatcagcacccggcgctcatcatttcccgtgtcacgctggcggcagataatgcccgcgctttcaagccgcttcagaagctggctgagcgtgccggaatcaagccggacgcgtgcaccaatatcagagacggtcaggcgatctttctcccacagcaccagcagcaccagatattgcggataggtgagtcccagcggttttaaccgcgactgatagagctttgtcatggcaagtgaggcggaatagagcgcaaagcagagaaactggtcgatagtttcaggcgctgcactggcgggaggcgtatcggagatccccgcgggttcgtcattcatatctttactcattctgagtccggggtgggacagccagaccccaggctgttggtcagccgtgaagtctcgcgaatagtatctcggggagatgttgatttcggcagcatctctttctggtgtaagacaccagacttttaagcgctatcgcagcgggagaaaaagcctttagctgcgtcgccgattgaaagtcggcacagtattgagtcaaattaaattgaagtcaacataaccggtcgcaacccttgcgcacaacgtgcgccgggtgcaacgcagctaagatcggcaggacaatttcagcatttaacccaggctgaagccgcccgccgatacggcttatacggtgaaggtctctaccatgccgcgcaggtcgcgcgcctgggccagcagtgactgcgatgcagaagaggactcttccaccagcgcggcgttattctgcgtgacgccatccatctgactcaccgcaatactgacctgggagatgccctgcatctgttcaccggaggagagggagaggttgtccatagcatcggccagttcaccgacgcggctgacaatcttcaggatgcgctcacccgttccggccgctacggttacgccatcctcgacctgcgtcacggcctgctcaatcagctgcttgatgtcgcgtgctgcggtggcgctgcgctgggccagcgagcggacttcacccgcgaccacggcaaatccgcggccctcttcaccggcgcgcgcggcttctacggcggcgttgagcgccagaatattggtctggaaagcgatgccttcaatcaccgacgtaatatcgcgtacccgaacggcactcagcgaaatgtcatgcatggtttctgacaggcgctggacatctgcttcgcccgcctgggccagggtggcggcctcgcgcgctgaaccggcagtctgctgcgcgcccgcggcgttgctttttaccgtcgcggtgagctgctccatgctggcggccgtttcctgcaacgcagcagcctgctgctcggtacgggatgaaagctcggtattgccctgcgaaatctcatcggccgccagcgccaccgaggcggatgcccctttgatctgcgtaaccagttcgcgcaggttggtctgcatgccgctgagcgacgcaagcaggctggtgctgtcgccacggcgcagcgtgaccggcgaggtgagatcaccggcggcaatcgcagcagccagcgtctgagcctgcaccggtttcgccgcccagctggcgcatcagtatccgcacaataaacgcgcaggtgacgacggcagccagcacggagagcaccgccaggatgatcagtatccaggtggtgcgggcgatagcgatgccgttatccactaccgcatcccggctgctgcgcatctcaagctccgtcagatcgtttatcgccttcagcaggctttgctgagccggacgcgccacctttaacagatagtcggtgacctcctgctgacgattttccatccccagtttcccggcggtcatcagcgtggagagagcggcctcttcagtggactcgattctgctcatcgcctcccgtcctgcctgtccggggtcggtctgcatcatgcctgagagtacttcgcggttgctgatataaagcgcgcgctgtttttgcagacgttcccattctggcttcatggcaacgggatcggtcagcagagcaaggttacgcaccgcgattgccatatcccgcacgccaccgcgcatatccagcaccgtctggtactttttcaaacggacattaaccacctcgtccataccatcgcgagcgctatccagcgcgtgaatcgcggtgccggtacagataataaacagcagaataagcaagccaaaacctgcgctaaggcgcgttgaaattttcatctctcgttccgaaagagttcattgggtaaaccggtatcggcaggagagagaacttctggagagttacgtttaactaaattgttcgctatttaatttaacgaaattaaaaattgcacgtatacccaccccgttatgccacaaaaatcgtaacgggagtgataacgaaattccggccaatatcctgataaatcgctttttatcgcctgacgagtgtgcgccttttcgcgcggtgcagccgcgcgatacgccagcgtcataacccgtcaaaaacaccggaatgcacaaatttaaccgggcgggcctgttaatctggctgctgctgccgatagaacactattcgacattgatgacgtaaccgacacgcatcgggctccgcagaacgtctgcctcactgccgtaaggcgagtgagaaacgtgcgaatgcgatgagtaaaaatagcggaggggtgataattgtcggcagcttagcagacattgtatgagaagtacgccccggttttttactgaaaattaaaacaaaactctgacactttccatcaccgggaactaacgcatgcgcctgaaacttttctggctcgcaatgctgaatattgcgaccatcattttactctccacgctgtgggaattcgggctcgaggcgtggatctccagcctgctgggcctgagctatgatcccgattttgaaaccagtgagcggctgcggtttatcctgacctccacctcgtttgccggactggcaatgattattccggcgctgcttattgcgggtctgatccgcaacacgctgcgtgcggaaaaaaacgcgctcaggctggccggaactgatgcgctgacgggggtcatgaaccgccgatcgttcacagcacacattgcttcgcttgatgccgacgggacgccctacaccctgacgctgctcgacattaatgactttaagaatatcaatgacctgaacggtcatcgtcagggcgacgccacgctggtcgcgctggccaatctgctgatcgcttcggcgggtaccgggagtcaggtgtttcgcatcggcggggatgaatttgccattgttgcccaggcttcacaggcagatcaggcgctggccgccgccgaaagcttctgccagcatgcggcatccatccggaccggtccgcacaccttcctgagcctttcagcaggcatcgccagctcatcctgcacgggtcaggctgatgtcgtgcgggcggcggatctggcgttgtacgaggccaagcaggataagtgcgcctgtctggcacgattctctccggacatggagctgcgctttcgccagcgggaaaggctggagcaggaggttgttgccgctataagcggtcacgccatcgttccctttctgcagccgctggtttcactgcgcaccggtaacattaccggctttgagatactggcgcgctggatcactgcgtccggtcagacggtttcacctgcagagtttctgccagtggtggagcggctggggttgatggacagcatgaccgtggcgctgctgcaggatgctgtcagtgcaacccgggcatggccagccgggctctgcctgtcgctgaacattaccccggagcagttgctgagaccgtcgctgaccagctgtttgtccagcattatgcagcatgccgggccggtaatgctggaacttgaaatcaccgaacagaatgtcatggccatttctgacgatgcccgccaggcgatccgtctgctgaaagaggccggtatcggagtggtgctggatgattttggcaccggctactccaacctgtcggttttgctggggctgggtattaccaaaatcaaaattgaccagacgtttatcgccggaatcgtgaccggatctgagcagcgaaaagtggtggaaacactgctggccctctgtcaggggcttaatgtgatcattactgcagagggcattgaggatgtcgccacgctgaggtggctgagaaagcgcggctgtgattatggtcagggatatctcttcagccgtccggtacctgccgggcaggccaccacgttgctggcgtctgctaacgtggaggaattgatgcaggaagaggcgatggccgttagcttagtcaggtcgctgggctgaaagcgcgcaacactctctgtggccgggattaaaacaataaacgggcccggcggtcagagccgggcccgctgtcacatcagaactggtaaatcagacccagggctgtgatgtcgtcggtcgccaggcgaagcggattgttatctttcaacaggttgatgcgatattcaccatagaccgacatgttcttgttgaagtagtaagtggcacccactgcggtgtatttaatgatgtcggcatcgccgatattctcaatttccttgcctttggatgagacgtaacccacggacggacggaagccgttcaggaactgatactgcgccacggcttcaaagttctgcgctttgttagcgaaaccgccagtaattggcgtggcgttcagcgtttcaccgtacatggcagccagatagacctggttcgcatcatatttcaccgaggtcgcccagtgctgggctttttcgccttctccgcgtgcggcagcgttctgcgccgtggtgcgatccaggctggcaaacgcgccggcaaaactcaggccgaaatcgaagtcataggaagcggagagggcgaagccgtcgccgttggaacgacgcacgccgtcaatgttactgctgcgatcgtttttgccctgatactgcgcggcaaggtttaagccgtcaaccagaccaaagaaattgctgttacgccaggtcagcacaccggttgagcggccagaaagaaaggcgtcggtataaccggagtcgccgccgaagaaacggcagcatatcggtataactcagcacgtcatagaccaggccgtagttacgtccgtaatccagcgaacctgcctcgccaaacttcaggccagcatagcccagacgggtacgattggtggcctgggcgtcactgccctcggagttatgcagactgtactgatactgccagaaaccgtagccggtaagctggtcagtaatcttggtctcgcctttaaagccaaaacgggcataagaggaggtatcaccatcgttgttgttatcgtcagaaaagaggtgtgacacgttaatcttgccgaccagatccagcttattgccatccttgttataaacttctgcggcctgcgcggaggagagaccgatcagtaacggcatgacagtcgccagtaaagtgcgcttcatcatttaattattaccctgtattcattaattattattcccctgatatggggtgaaaagaaaatgacacaaaaagataaaactacaaagtgcaataaaagtaacaaaatgtgatgtctatattcagctgatggataacagcgaggaacagaagattaaattgtaaagtaataagattttcttctaataagtaatcatgagttatctgattttatatctctatttatcaatggattatgtttgtatgtagtggtcttaaatgggctttttttgtacatttttaaatcaatataacccctgatttaattatgggtgattatccgctaagaatagccttataaggcttttatcctaaccattagtctgcgtattaatatttgttcatctttatagaatattctttctggcccgataatcacctccggaataatagtcagagttgctgattaaatattgatcagcctgtttataaaatagcctggaaaagatacgcggattaatgtgtctgcaggggaaatgaaaaaatttgttaaataaagccagggtgttctaacattttcgggcgagttccccgcgtaatcgctgcaccagcgcgaggcaaactgcgctaaaacagggcagtggaggggcttttctggagagataatttatcagcgatcacaaaagcgatatttcatcccgtgaatgcataattctgctgtttaaaacccggttctggcgctgcaatcagacaactattcactatatatgcaaattaagtgaatattgtcagcatctaactcattgatattacgtcgtgaagaccattttatgcattaattctctggctggcacgttaactgcactctacagtagggctgcattacaacatcttttaacaattttaaaacataagctttacccggccggtaaagtaaagcaggagagtgggttatggcactgcacgtttcacgtcacgatttcgatcaatggatgatgccggtttatgcgcctgcgacttttataccggttcgcgcggaaggctccaccgtctgggatcaaaacggcaaagattatatcgacttcgccggtggcatcgccgtcaatgcgttagggcatgcgcatccggcattacaacaggcgctgcaggaacaggccgcacgtttatggcataccggtaatggctacaccaacgaaccgatcctgcggctggcgaagcagttgatcgatgccaccttcgctgaccgggtgttcttctgtaactccggggcggaggcgaacgaagcggcgctgaaactggcgcgcaaggtggcgcatgatcgtgtgggtccgcataaaagtggcatcgtggcgtttaagaatgcatttcatggccgcaccctgtttacggtaacagccggtggtcagcccgcttactcaaaagattttgcgccgctgccgccagagatccagcatgccccgtttaacgatctggcggcggcggctgaactgattaatgaccatacctgcgcagtcattgttgaaccgattcagggtgaaggtggcgtgctgcctgccgatccggcgtttctgcgtggattgcgtgagctctgtgataagcatcaggctttgctgatttttgatgaagtgcagagtggcgttggccgtaccggttcgctttatgcctacatgcattatggcgtcacgccggatgtgctcaccagcgccaaagcgctgggcggcggcttcccgattggtgcgatgctgacgcgcgaagatctggcgctggtgatgggcgttggcacccacggcaccacctatggcggcaatccgctggcgggcgcagtggcaggtaaagtcatggagctgatcaatcagcctgaactgatggcgggtgtaacagaaacgtcaccagtggattgtggcggcactggatgagatcaaccagcgtctgcacctgttcaaagaagtgcgcggtcttggcctgctgattggcgcggtgctcagcgacgattttgctggtaaagccaaagcgatcaaccttgccgccgcggaaatgggcgtcatggtgctgattgcgggtgccaatgtggtgcgttttgccccggcgctgaatatcagcgagcaggaagtgaagctgggcatggcccgctttgccgaagtgtgtgaaagcctggtgcgagggtcaacatcatgatggtaatccgtccggttgaacgcgatgacttaagccagctgatggcgctggcgggcaaaaccggtggcgggctgacctcgttgccggttgatagcgcgacgcttcaggcgcgtatcgatcgatcgctgcagacctgggaggattctctgccacgtgccgaacagggctatgtctttgtgctggccgacagcgaagataaccgcgccgtcggtatctgcgccattgaggtggcggtgggtcttcaggatccctggtacaactttcgcgtcggtacccaggtgcacgcctcaaaagagctgaatgtttatgccgcgctgcctaccctgtcgctgagtaacgaccataccggcagcagtgagctctgcacgctgtttctcgatcccgattaccgtgatggcaaaaacggctatctgctgtcgaagtcacgcttcctgtttatggccagtttccgtgaacgtttcaccaaccgggtggtggccgagatgcgtggcgtcagcgatgagcagggccattcgccattctgggagagcgtcggcagccgcttcttctctatggaattcagcaaagcggacttccttagtggcaccggacagaaatcgtttatcgctgaactgatgccgaaacatccgctctacatcgactacctgacaccggaagcgcaggcggtgatcggacaggtgcatccgcaaaccgcgcctgcgcgggcggtgctggaagcagagggcttccgctacctcaattatgtcgacatttttgatggcggcccgacactggagtgcgacatcgatcatatccgcgccgtgcgtaaaagccggctgcgcagcgcagaaacggggcgaaaacccggctgatggcccgctctgtctggttgccaatagcgattatcgccagttccgtgtagcgctgattccggcaaaggctgacagcgacagcgtgcaactcacggatgaacagatgcgggcgctccattgccagccgggcgacagcctgcgcgtggtgacgctctgcaaagaggagaaaacagcatgacacatctgataaatggacaatggctggacggtgatgctgagattctgacgaaagcggatccggtcagcggcgagacgttatggcagggccacgcggcatcagccgctcaggtcaccgcagcctgtgaggcggcgcgcgacgcatttccagcctgggccagacgcccgctggcggaacggcaggcgatcgttgagaaatttgccgccgggcttgaggcgcataaaacggcgctggcggaaaccatcgcccgtgaaaccggcaagccgcgctgggaagcgctgaccgaagtgggcgcgatgatcaacaaaatcggcttttcggtgaaggcataccatagccgcactggtgaacagcatgaaggcgaaagctcgctgcgccaccgcccgcatggggtactggcggtgtttggtccctataacttcccgggacatctgccaaacggccatatcgttccggcgctgctggcgggcaactgcgtggtatttaaacccagcgaactgacgccgctgaccgccgaaaaaaccgttgagctctggctggctgcgggcctgcctgccggcgtgctgacactgttacagggcggacgtgagactggtcaggcgctggccaactgtcagcagattgatggcctgctatttaccggcagcgcccataccggctatcagctgcatcgccagtttgccggtcagcctgaaaagatgctggcgctggagatgggcggtaacaatgccctgattgttgaagatccggcggacactgatgcggctgtcaacatcacgttgcagtcagcctttattaccgccggtcagcgctgcacctgcgcgcggcgtctgctggtcaaacgcggcgatgcaggggatgcgtttctgcggcggctggtggaggtggcggggcgactgcaacccgccgcctggaatactgaaccgcagccgtttatgggcagcgtgatctccaccggcgcagcagagaaaattatgagtgagtggcaacggcgggttgaggcgggcggcgaggtgctgctggaaatgcgctggccggatcgccacagtgccatcctgacgccaggtattatcgatttaaccggcgtgcagggcattccggatgaagaggtctttggtccgctgttaggcattgtccgctatgagacatttgaagaggcgatagcgctggctaaccagacccgttatggcctgtcgtgtggattgatctcgccttcacgccagcagtttgatcagctgctgcttgaagcgcgtgccggtatcgtcaactggaacaaaccgctgaccggcgcagccagtaccgcaccgtttggcggcattggtgcctcgggcaaccatcgcgccagcgcctggtatgcggcggactactgcgcctggccgatggcctcgctggagacgcctgacctgacgctgcccgccacgctgtcgccgggcctcgatttctccacccaggagacgacgtcatgaaggcaaccgaggccaactttgatgggctggtggggttaacacaccactatgccgggctgtcgtttggcaacgaagcctcgacccgcaatcagctgcagccgtcgaatccccgtctggcggcaaagcaggggttgctcaagatgaaagcgctggccgatatgggctacgtgcagggggtgatcccgccgcatgagcggcccaatattgcggcgctgcgccagctcggctttggtggcagcgatgagcaggtgctggctgcggccgggaaaactgcgccgggattactctctgccgtcagttcagcctcggcgatgtgggtcgccaatgctgccacggtctcgccgtcagcggacagccttgatggccgggttcacctgacggtggcgaaccttaacaacaaattccaccgtgcgatagaagcgccggaaacggcctggctgctgcgttccatcttccgcgacgatcgccattttgcggtgcatgatgctttgccgcaggtggcgatgtttggcgatgaaggtgcggcgaaccataaccggctgggcggcgcttatggtgagcgcggcgtgcagctgtttgtctatggccgcgacagcagccatgagggcaaaaccccgcagcgttatccggcacgtcagacccgggaagccagcgaggcggtcgcccgtctgcatcagctctcaccggaaagcgtgctgtatgcgcagcagaatcctgcggtgatcgatcagggcgtgttccataacgatgtgattgcggtgagtaaccagcagatgctcttctgtcaccagcacgcctttgttaatcagcctgaactgctggcgcagcttcggtcgcgcgtccccgattttgtggcgctggaagtgccggaaaatcgggtgtcagtgaaagatgcggtagagacctatctgtttaacagtcagttgctgagccgtcccgacggcaccatgatgctggtgctgccggaggagtcacgtcagcatccgggtgtctggcgctacctgtgtgaacaggttgaggctgacacgccactcaaagccctgaaggtgtttgatctgcgcgaaagcatgtataacgggggtggtccagcctgcctgcgtttgcgggtggtgctgacaccacaggagcagcaggcagtgaatccggcggtgctgatgaatgatcggctcttcagcacgctgaataactgggttgaccgtcattaccgcgatcgcctgacccaggccgatctggtcgacccacaattgctgcgtgagggacgcgacgcgctggatgaactgacgaagctgctagacttaggaaatgtatatgcatttcagcagtgaaggagggggcagcacaggctgccgcctgctcagggcgaaaaggaggaacgatgcaggactttttacagcaaacgctctccggcgaggtgccgcgtaagcgtagtggtgaaacggcgcatcttcgctggcaatggttgtatcacggcatactgttgatggagccgacggtgccggttaaacaggcgctggtgctctctgccgggatccacggcaatgaaacggccccggtagaaatggtgaaccaactggttaatccgctgctgcggggcgaaaagccgttacagcagcgcatgctggtgattctgggtaatccctcagcgctacgcaccggtaagcgctatgtgcgttatgacattaaccggctgtttggcggacgctggcagcagattgatgatggtgatgaggcccgccgcgtgctgcggctggagcaggcgctggagaccttctggcagctgggcgagtgcgatgaaacgcgctggcatctcgacatgcacacggctattcgtggctcttatcatcctcagtttcggcgtaatgccgcacaatgaacgcccctggccgcccgcgtttcttgactggctggccgctgccgggctggaagcgctggtgttccatcgctcgccgggcggcacctttacccacttcagctgcgagcacttcggtgcggccagctgtaccctggagctgggcaaagcgctgccgtttggcgaaaacgatctcagtcagttcagtgcggcacagcaggcgctggcgtctttactctatggcgaagcgctgcctgcggcggcggttagaccgcgtcactatcgggtcgcgcagcagatcacccgactgagtgagcactttacgctgcatatgtcgccggaaacgctgaactttaccgcgtttccacaggggacgttgctggcggaagatggtagcacccgctattacgtgcagcaggcgcgggaatatgtgctgttccctaaccccaacgtggccgccgggctgcgtgccggactgatgctgattgaagagagcgaacagacccaggcgctgccggtctgatagcggttgttaacagcgcagaccctcggcgctaaaaaaccgacaggaaaagtggaagatcggcttccgctttcctgtcgtaacccttacactcctccatgatttctgccaaattcgctttaaattcataaacattttcaattcctcacgcctttcttcttattctcttcatgattgcccgatttttatcttttatgctttcacggctttactcaggctctgagtagttgacgttcagcgtcgtatgcttgtttccgaagacgcgacagagtgctgtcgtcattatcatgaattataaggacactattatgcgcaaactgacttcccttttactggcttcctcgctggcgtttggtgcagccagcgccgtccatgcagccgctgacaacctgactccaccgccagcaggcagcgaaaaagcgatgcacaagccgccaatgcgccacggcatggagatgatgtttaaaggtctgaacctgaccgacgtgcagaaaactcagatgcgcgacatcatgaaagagagccacaaagatatgaaacgcccgtcactggacgagcgtcgtgcggcccacagcattattgcctctgacagcttcgaccagagcaaagcagaagcacaggcagagaagatgtccgccaatgccaaagagcatgcgctgaagatgctggaaacccagaacaagctctataacgtgctgacgccggagcagaaaaaacagtacaacgctaactttgaaaagcgtctgactgagaaaggcccgcacgagggcaaaatggcaccgccagcagaaccggctgaataacactcgttaagcgaacggtctgagaccgccggcgctgtccactgaaggtgagtgggcagcgtcggcggtttttttatagcggcagaatagggtaggcacctgacagaatcgggcggcagaggattttgtagccgtcgtgatcaaaaccgcctttgggccgctgcagttttctggcctcatccatgctgctgaccgaaccgagatagaaccagtggtcgataacgtggatctgcgtcatctctttgccttcctccaccagccccacggcaccctgccacggccagcagaacacccgcacgttttccagcgcctccagcagtcgatcctgatgatcgctgaccggctcttttccacagcaggccccggcgcaacggcgcagtgccgagcggaagcagcctcgccccgcactcagcgcttccagacccagcaggccatgacagagctgatactcatccgcgagctgcttgagccgtttccagcgcggcgaagcgactgcgatagagcccaaacaggttgggggactggctgaaatcgaggtcttttgcgtagaccacattcggtttgccgtcggtaatctgcaatgaacagagctgccggtttttgcgcaatcgcttattgaacagcggctgctgggttttgatcatctgcgcttccagcagcagcgcgccgaggtcacccgcggtagggatccagcttacacgccgcgactggcgcagcattttcgcctcatccggggtgcggaaatgggacatcacccgcgaacgcagattcacacttttaccgatatagagcggcagcgactcactttcgccatgaaaggtatagacgccaggatgatttggcaggccttccagccactcacgcaggtgttcgggatattgataaattgcattcgcgtcgggttcggggcgaagtatggcagaacgtctgaccaagatggactccatttactggttgtccatacagcataacaggcaggtgaaatgatcgccagccgtctggttacagagaccgtgttgcccgccagcagatcagcgagccgagcgtgatcatcgccacgccctgccagaaggccagcggcggcgtcaggccgagccacagtgatcccatcagggccgacagcaccggcgtaaagtaggaggcggtggccagcagcgtcagattgccctgctgaatcccgtgattccaggcggaataggcgatggcggtggagagcccgacaaacagcacctccagcagcggcaccagcgtaaaggccatcggcacagtgtgatcgctgaaggcatatttcagccacagcaccagtgcagtcaggataaaaaacagcgtgacgccattagaaccacgggcaaagcggcgggtgagattattgtagagcgcccaggtcagggcggcgataaaggccaatgcataggcgaccgggttgcgcagcatattctgccacaacagcgtcggcgatccgctgccgctgcctttcattacccagacgatccccagcagcgacagcagcagtcctggccacagccagacacggaaacgctgctgattaaacgggatcgccagcacgatggtcaggcagggccagagatagttaatcattcccagttccagcgactggctgcgatcgctggccagcccgatggccagcgccagacagatttcatagccgacaaagagtacgccccccagccacaggtagatagcgggcattgcgccaggtctgggcaggccccggctcaggcaaaggagacacgccgtagtagtgtagatcagcgccgcaccaccggtggcgccaaaggcttcactgacgctgcgcagcaggccaacggtcgtactccagagcagaatggcgacaagcccgatgagggtcgcgcgcgaaacggtggcaggcatgcagcgatcaacaaagtcagtgagagaagcctcccttgccacggcaagggaggggcaggattacttccagaaatcgtcgaataccgtgatcggcggacgacgtttgtgctcggttttctgataccagccttcgatgatacgggcgctgtcaggattgatgcttttgccttccaggtagtcatcaatcatctcataggtgacgcccagcgccacttcatcctgcaagcctggacgatcatcttccagatcggcagtcggtttcttcagatagagatgctccgggcagccaaggtgtttcagcaactgcttgccctgacgcttgttcaggcggaacaggggattgatgtcagtgccgccatcgccatacttggtgaagaaaccggtcacggcttcagccgcgtgatcggtgccgaccactacgcctttggtcatgccggcgatgctgtattgcgctttcatccgctcacgggctttttcattgccgcggacaaaatcggaaagcgtaatacccgcctctttcagcgcgcgctcactggccagcaccgactctttgatgtttaccaccagcgaaacggtcgggtttgataaaggccagcgcgtcctgacaatcctgctcatccgcctgcacaccatagggcagacgcacggcaataaaggtgtagtcgttatcaccgctctcctgacgcagttcggtgatcgcccgctgcgccagcgcgcccgccagggttgaatcctgaccgccgctgatccccagcaccagcgttttcaggccgctgtggcgtttcaggtaggctttaagaaaatcgatgctgacgcgcacttcctggtcggcgtcgatagtgggcttcacacccagggcttcaataatttcctgctgcagtgacatgaacttctcctcaggtcagtggcctgtcggctcgatgcgaacgttttattaaagctaacgtgcctttgcgaaaacaacaagccaaagcggtaactgattgccgtgaaacgttgcgaaatcagtgagtttttacctgcggcagcggttttttcgccagcacgttaaacatcagaatcgccgtcataaagcagccaaaaatggtggcgcacatgctcagcaccgaggtgccgccgatgccggtaatcggcacggtaatcgcacccagcgtgaacatcgtaacgcctatcactgcagaggcgctgccagcgcgatggccctgactctgcatcgccagggacgaggcggtggtagcgataacgccgttactggcaatggtaaagaacagtgccaccagcagcagcgctaagggagcatgcagcaacgcggccagcagcagcagactggaggcgacaaaggccagcgtcagtccgcctttcagcacctgatattcgccccacaatggacagaggcgggcactggtctgtgaagcaatcaccaggccaaacccgttggccgcaaagcagaagctaaaggcctggggcgaaagaccatagagttgctgcagcacgaacggcgaggcaccgatgtaggcgaacatgccggacatcataaatccctgggtcaggcagaagcccatgaaggggcgatgggtaatcacctgacccaatgccgcgtaggcggagaatattgatcctttactgcggcgtgcctcaggcagggtttcatgcagcttccagcgcgccagcaggatcagaagaatggcaatgccgcccagcaccatgaagatgccgcgccagtttaaaatcgtcatcagcacgccgcctaataccggtgcgccgatcggtgccagaccgttgaccagcatcagcagagcgaagaaccgcgtcagctcgtggccgctgtacatatcgcgtgcaatcgcccgtgacagcaccgcaccgcccgcacctgctaacccttcgaacagccgcgccagcagcagctggttaatatcctgcgccagcgcacagcccatcgaggcgataaacagcaacaccagtgacagggtcagcgggcgcaggcggccgaacttatcactcatcgggccaaagagcagctggccaaagccgagacctaacaggccagcggtcagactcagctgcgcggtagcggtttcggtgtgcaggtcctgggccatttgtggtagtgcaggcagatagaggtcgatgcagagcgggcccagcgcggccagcaggcccagcgtaatggcataaaccaggcgattggagtgtacaggggtcatttatcctcgggattgtcagcgatggggtaaacagaaagcgggtaaggctgcgaaaaacagcgtccggtaacgcgacattcacgccgatctgcgtctgcgcggatgacggtgcggtctctgaaaacggggcgctatcgggtgcctgttttgccgggcagtatacgtctgcgttgacagcaaaacagccttctttacgaaatcctgacatttgacaggccactaattgttcgtcataaacttgataaatcagcatttatgttccaggcttgtttccacatggacaataaatgaggaacaacaagatgaataaagtgatgggatgtatcgctgcggcgctgacgctggctgcactgtctggttgtacgacttacgatcgtgcggaaagctacgtgactaagccagtggtaaaggatgttaaaaagggtatgacccgtgatcaggttcgtcagatcgccggtacgccttctactgaaatcaccatggttcacgcgcgcggcacctgccagacttatgtactgggtcagcgcgacggtaaagctcagacttacttcgtgagctataacgacaccggccgtgtcatgaactacggcttccagagctgtgcggaatatgacaccgatccgcaggttcagcagtaactcatagcacccttgaatagcaaacggcccgtcattatgacgggccgtttttcgttgtggcactgactacaaacctgccgggcgcggcacctcaacataatcgccatctatctgccgctggtagaagtggccagcctgcacatagaagcgtttgccgttaaagtcgagtacccgcatttcactgctgacccgcgactctgcaggcggctctgccaccacatactcatcgccgtgacgctgataataattgccgttgagcagatagtaggtcagtccgcctatcagcaccgcggttgcggcttcaggcaaaaagcgcaccggcccgggtccgccccagtgtggcccgtggccgccatgtcgaccccatccacccggcggtccccagtcgccaggatgggcgaaagccagagcgggtgtcaaaagcgtcagcgtcagaagcgaggcgattatctttttcatcaggtgttctcctcataagactggatgcagaattcgctttttacccggcaaagacaagcactaaagcggcgatttttcgcctgtttaccatgcttaacgctttcttaacggcgtcgccattaatgggggagattatggagaggaagggcgggaataacctggcgcgggcgcgccaggttcaaagcagattagcggtgcgccagttcggcgttgtcgtcgctttccaggacgcgcttatcggtcatacctaaccagcgactggtcagagaaccggcggtcatggaaccgttgacgttcagggcagtacgacccatatcgatcagtggctcaatggagatcagcagcgccaccagggtgaccggcaggcccatcgcaggcaggacaatcagcgccgcgaaggttgcaccaccgccgacaccggcaacgcctgctgagctcagcgtcacgatcccgaccagtgtcgcaatccacagtgggtcaaacgggttgatcccgacggttggcgcaaccatcactgccagcatggttggatagagaccggcacagccgtttctggccgatagtggcaccaaaagaggccgcgaagctggcaattgactcaggcacgccaagacgacgggtctgggtctcgacgctcagcggaatgctggctgcgctggagcggctggtaaaggcgaaggtaataaccggccacactttacggaagaagcgcatcgggttgataccatttaccgacagcagcagggcgtggacaccaaacatgatggccagaccgaggtaagaggcgaccacaaagctgcccagcttgatgatgtcctgcaggttagaaccggcaaccactttggtcatcagcgccagcacaccataaggcgtcagcttcatcactaaacgcaccagcttcatgacccaggactgcagcgtatcgatcgcgaccagcacgcgctgacctttaacttcatcatctttcagcaactgcagtgcagctacacccaggaaggcggcgaaaatgacgacgctgataatcgaagtcggactggctccggtcagatcggcaaacgggtttttcggaataaaggagagcaccagttgcggcacggtcaggtcagccactttgccgacatagttgctctggatcgcactgagacgcgcagtctcctgcacgccctgaaccagaccttctgcgctcaggccaaacaggccggtcacgaagacgccgaccagcgccgagatcgcagtggtaaacagcagtacgccaattgtcagtacgctgatttttcccagcgacgaggcgttatgcagacgggcgaccgcactcagaatggaaacgaacaccagcggcattacgaccatctgcagcaactggacatagccattaccgacgatgttaaaccagctgattgactctttgaccactgcgctgttttcgccgtagatcaactgcaaaaccaggccgaacagcacgccgatcaccagaccggtcagcacttttttcgacaggctccagttctgacggctgaagcgagagagcaataccagcagcaccacaaaggctacgatattaagcgtaagaggaaggtccatactgaaactccagagtaatgcggcctttcgctcaggaaaggccgcataatgttaatcacgaattaagacagcaggaatggtaacagcaggcgaagagggtgccttatatccaaatggcatggtttataacttaaaggcattttatgctgatttattgcgcattatgactggagatcaaccgtccgacgccattttgtagcgtatcgaacagctgtgacggccagccgtttgcaccaaaagatggcatgcccaccggaaaccagagcgcatatcccaccagtcccagacacaatgcccgctcaagctggttgcctttctgactgcgcagaatcggcagccggaagcgccagcggcagggccacagtagcggaaccccggcaggcgtcagcatatcggccacaatatggctaaggtagcccagcgtcagaccttgtaagacatcaggcggtatcggcgacgaccggggcaggtttatctgaaaaagccacaaaccggcggctatcgccagcaaactgtgggtaaagccgcgatggccgaacgcgcgcgcaataggatgagagagccagcgcagtcgctgtcccagcagagatttagggtgatcgatatcgggcaacagacatgtcagcagggctgagggaactagatgccaccagtcggcttgcgccagcaccggtgtcagctcagcacgcttcgcaaagatagcgctggcaatggcaaaaatgatgtggccttcgcccgtcatgatagaacctggttgcaaagaaaactgtcgatgcatccagtatagggatttatccagtaaatgagaacatgtgacgctgtaacgaagcatgaatattattaacaaggcggacagcgatgaaacactgtccgccagtaagattaacgcgccagccagccgccatccaccgccagggtgtagccattcacgtagtcagacgcggaagaggccaggaagaccaccgggcccatcatgtcatccggcacgccccagcggcctgccggaatacgccccagaatctcttcactgcgcgactcatcattacgaagctgttccgtattgttagtggccatgtaaccgggagcgatggcattgacgttaatgccatgttttgcccactcgttcgccatcagacgggtcagtcccatcacggcacttttcgacgccgtataagagggcacccggataccgccctggaatgagagcatggaggcgatattgatgattttgccgccattaccctgcgcgataaactgacgggcaacctgctgcgacaggaaaaacaggctcttgctgttaagattcatcacgtcatcccagtcctgctcgctgaaattcagtgcgtcctcacggcggataatgccggcattgttgaccagaatgtcaattttaccggcagcggccagcgcctgttcaaccactgaggccaccacgctggtctgcatcagatcggcctgcaccggccagaaccggcgacccagcgcctccactttactttgggtatcatccgggccatcacggttaacgccgacgatatcacaacccgcctgggccagacccagcgccataccttgccctaaaccggtattacagccggtcaccagcgcgactttaccttccaggttaaacgtactcagtaccatggtatttctcctctgctcagcgcagttcactgattttgacgtggtccatgtcatcaaagacctgattctcacccaccatgccccagataaaggtgtaacgctgggtgccgacaccggcgtgaattgaccagctgggtgagatcaccgcctgctcgttgtgtaccagcagatggcgggtttgctgcggttgccccatcatgtggaagacggcgcactcttcgctcatatcgaagtagaaatagacttccatgcggcgtttcgtgggtgtggcagggcatggtgttccacaggctgccttcatccagtttggttaagcccatggtgagctgacaggtgggcaacacatccggcacgataaatttgttaatggtgcggcgattggatgtcgcggcatcacccagcgtcgcggtggcggcttcctgcagcgtgattttcttgtccgggaaggtgctgtgtgctggcgcactgttgtaatagaatttggccggctgcgcagggttcaggctgcggaactgcaggttgcgcgcacctttgccgatgtaaagtgcctcttcgtgaccgatttcccacgctttaccgtcaacttctaccagacccgggccgccaatattgatcatgcccagctcgcggcgttcaagaaaataagcgacgcccagctgttttcccatctcatcaccgatagtgaccggattattcaccggcatgacgccgccaataatgatgcggtcgatatggctgtaggtcagggtgtaatcatcggcagtaaatatcttctcaatcaggaactcgcggcgcagtgcttcagtgtcgagttgcttagcgtgatcgctgtgaatgctttgacgaacgtccatctcaggcctctctgcaggtcaggttattcatgccccaaacggggacgcttttggcatcttaggcagagcgggatgggaattcaataaaaatgaaacgttgttttattttttgcgggtcagatcaagtgacaggtgcaacaggcaataaaaagcccgccataagcgggctgatattatccctgcagatgctgcaggctaagctgggtcagattgtccagccggacatccgccagcgtccagcggggatcgtcacggtgttcagcggcgggcaccacaatcgatcgcattcgcgctgctttggtggcgatcatgccgttaaacgaatcttccagcgtgacgcagttgagcggatcgatcgcaaggctggcggcggcgttgagatagacctgcggatggggcttgctgtagggcagcgcttctgctgaagccagtacgtcgaaataagggcgcagattgaagatctccagcacctgttccagcatctttagcggtgatgcggaggcaaggccgattttcagcccctgttcccggcacagttgcagcgccgtttccacgcccggcagcagtggccgcgtctgatccaccagcgtcatggcgcgcgtaataatccgctcagtgacctcctgctgagaggggccatgccagggcagcgtttcgtaccacatccgtacagtctgatcgatgcgcagacccagggtatcgggcatttcactgcgacgtgacaggtcaacatccagcgttgaaaagatatcgagctcagcctgatcccacagaggctcagaatcgatcagtaagccatccatatcaaacagggcagcaaggacagggcggtgataaggcatcagggggtctccttttaaagtcagctttaccttaacatcattctttgctggcgcacgctctgcccgacaggccacgctttatttgggaaatttcaccgttggcaggtaaactgacggcaaattggattccgggttcaggagatattatgacctatcaacaggctggccgtatcgccatcctcaagcgagtggcaggctgggtgctctttttagtggcgctgctgtcgaccattatttctgtattgagctttatgtttaagcatagcgaaaagcagccaggcattgatgccgtcatgctcgatttcgtccacgtcatcgtcgatatgctgcgctttaacacgccattcctgaatgtcttctggcataactcgccggtaccggaatttaacggtcagatgaacctgggtttctggctgatctatattctgatttttgtcgggctggcgctggagtcgtcaggcgcgcggatgggacgtcaggcgcgtcatgtcaaagaaggcattgaggatcagatgattctggagcaggcaaaaggcagtgaagggcgtagccgtcagcaactggaagagaaggtgcgcgtacctcgccacaccatcttcctgcagatcttcccgctctatgtcctgccggtggtgattgcgatagccggttattttgcgctgtcgctgctgggctttatctgaccgcgatctttgtcaggccggtctggcctgactggcgcccagcgcatcctcatccagcaactggccaatggcgaaactgtgcatcgcctggccagtgcccgccaaagacgttagcccggttgagcagatagtagagctggtagaccggcagacgctgcgaaaaaccatccggtagcggccacaccgtctgataaccgtcgtaaatctggcgaggcaggtcagggtaccagctcagcatggctaaatcgcactcacggtcgccccagtagcaggcagggtcgaacagccaggggccactctcactgctggcgcagttagccggccagagatcgccatgcagcagcgacggttgcggatgatgtgacgcgagcacccgctgcacgcaggcaacgatcagctctgtatccccgtactgaattcccttttctgccgccagttgcagctgccagccaatgcgctgttcagcaaaaaaaaccgaccagcggcgcagccagctgttgggttggggcgtcgtggtgatgttattgtcgaaatcgaggccgaactgcgtctgctcgctccactgatgcagatgcgccagttgctgaccgagctgatatgcactctgctcatcaagcggctgtggcctgatatattccagcagcagaaagctctcctcgcgatgatgacccacaccatagactttaggcacccgaaccgtgccggtgcgcgccagcaaatccagctggtctgcttcccaggtaaagagcgacagcatatcgcggctgttacttttgacgaagacgtcgtgatcaccgtagcggatctgccaggtgggatggatatcaccccccgcgagggcgtgacgttgagtgatttcggcgttgcctaactgctcgcttaacagacgactaatggctgaccacattgggctatcctcgttattcgctgcgtaagttcgattgtattgcgtaaatattcaccaaaaaccgcgcaattgcaccctttattctggcgctgaggtggcagggcgatgatcggcagcatcgcgcagatactcttcgaaggtcgtgacggtcacctcgggtttcctgacccagcgcgctttcaccggccgcagtgacctgctgccgcagatcctcagcctccagcgtgctgacgatgccatagctgttcgtaccgagttcatgcggatggccgtcgtcatctgtcatcgtggtcgtgaaacctgcggcggtcattgcgctggtcagctccaggatgtcacttaagcccgactcctgatagtgaaaggtcacgatatagcgggttaaggtgttactcatgaggcacctccggggaagggaaactgaactgagcgtagaccatggtgaaaaatcaggcgaattatgaaggagatgctgcgtgtgtgacgtgatgcatagcgtaaattcgtgtcaggagccagcagcataacgtaaaaatcttctgccgttgcgtctggcttttcgtttgagcagcactataatgcgcgacgttaataagatgagtcccaattaacaggggttgtcagggtgattccaggcattttgtgtaagttaataattttttacaaaacttaccgtaaattgcattgaatgcccggcaaaacgcttcagactctccgttttttaaacagtcgcacggatcacatttaatgaaagcctataacaagctgtctgctgttcttttgctctccgccggagctttctgtcaccaggcaatggccgataacgccgtatttacgtcaatggatgacccttcaacagctaaaaagccgtttgaaggttctgctgctgcgggatatctggcgcaaaccggtaacaccaccagttcatcaatgacggctcagaccaatatgacctggtatcagtcatctatggcttacagcttgtggggtaacgcagccaacacctcgtcaaacgatgagcgctcttctgaaacttacaacatcggtggtcgttcacgttacaacctcaactcgtatgactacctgtttggacaggcgagctggttaagcgatcgtttcaatggttacgattcacgcgacgtgctgacagccggttacggtcgtcagattctgaatggtccggtgcactcgctgcgtgcggaattgggtccgggtgtacgttatgacgattatcacgcgggtggtcatcagaccaaagcgctgggctatggcgcagtcagctatcagtggcagctgaccgacaccactaaatttattcagggcgtgtcggtgctgagcagcttcggagaagacaccacggtgaactctgaaactggcctgcaggtggcgatcaacagccacttcgcgctgaagctggcttacaacgtcagctggaacaacaatccggcggaatcggcacctgatcgtaccgataccaaaacctcaatcatgctctcttacgctatgtaagcgcatttttgcagcagcattcacagcggcctgacagtgtgtcaggccgcttttttttgatttctccagggcttagcgaaaaaggcatgggtttttctcgccggggaaaactgctatcatcggccccgcactgaaatcctggcgacattccgacaatgtgggtctgatatcacgccgggtcactaattttacattacgttgcatgtaggctttcgtgtggcttaccactgcaaataaggatatgaaatgcctgtaattacgcttcctgatggcagccagcgcgtgtttgaccgccctgtcagtgtgatggatattgcgctggacatcggtcctggtctggcgaaagcctgtatcgctggccgtgttaacggtgaactggttgatgctgttgatcccatcactgaagatgccgccgtagcgatcattaccgctaaagatgaagcgggtctggaaatcatccgtcactcctgtgcgcacctgttagggcatgcgattaaacagctgtggccggataccaaaatggcgattggcccggtcattgataacggcttctattatgatgtcgacatcgatcgtaccctgacccaggaagatatcgacctgctggaaaaacgcatgcatcagttggctgaaaccaactacgatgtggtgaagaagaaggtcagctggcaggaagctcgcgacgtctttgcggcgcgcggcgaaatttacaagaccaccattcttgatgaaaacatcagccatgacgataagcctggcctgtatcatcacgaagaatatgtcgacatgtgccgcggtccgcacgtgccgaacatgcggttctgccatcattttaaactgcagaagatctccggtgcctactggcgcggcgacagcaacaacaaaatgctgcagcgtatttatggcaccgcatgggcagacaaaaagcagctggcagcctatctgcagcgtctggaagaggcggcgaagcgtgaccatcgtaagattggtaagcagctggatctctaccacatgcaggaagaagcaccaggcatggtcttctggcataatgacggctggaccatcttccgcgagctggaagtgtttgtccgcagcaagttaaaagagtaccagtaccaggaagttaaaggtccattcatgatggatcgcgtcctgtgggaaaaaaccgggcactgggaaaactataaagaagcaatgttcaccacctcatctgagaaccgtgaatattgcatcaaaccgatgaactgtcctgggcatgttcagatctttaatcagggtctgaaatcctaccgtgacctgccgctgcgtatggcagagttcggcagctgtcaccgtaatgaaccctcaggcgcactgcacggcctgatgcgtgttcgtggctttacccaggatgatgcacacgtcttctgtactgaagagcaggtgcgtgacgaagtgaacagctgtatccgcatggtttatgacatgtacagcaccttcggttttgaaaagattgtggtgaagttatccacccgtcctgagaagcgcatcggtacggatgagatgtgggatcgtgccgaggaagatctggctgcggcgctgaacgaaaacaatattgagtttgagttccagccaggcgaaggcgcgtttctacggtcctaaaattgagtttactttgtacgattgtcttgatcgcgcctggcagtgcggaacagttcagctagacttctccctgccaaaacgccttgaagcaacctacgtgggtgaaaacaatgatcgtcagacgccagtgatgattcaccgtgcgattctggggtcaatggagcgtttcatcggtattctgaccgaagaattcgccggtttcttcccaacctggctggcaccgctgcaagtcgtggtaatgaatattaccgacggacaagcagaatatgttgagtctttgacgcgtaagctgcagaatgctggcattcgtgtgaaggcagacttgagaaatgagaagataggctttaaaatccgcgagcacacattacgtcgcgtcccttatatgttggtctgcggtgataaagaggtggaatctggcaaagttgccgttcgcacccgccgtggtaaagaccttgggtcgatggatgtcgatgtgtttgttgagaaacttcaacaagagattcgcagccgaaatcttcaacaattggaggaataaagtattaaaggcggaaaacgagtactaccgacgcgtccgaacaaaatcaacagtgaaatccgcgcaactgaagtgcgcttaacaggcatggatggcgagccgattggcattgtcacattacgcgaagctttggaaaaagccgaggaagcgggcggcgacttagtcgaaatcagcccgaatgccgaaccgccggtctgccgcatcatggattacggcaagttcctctatgaaaaaagcaaatcttctaaggaacagaagaagaagcaaaaagttattcaggttaaggaaatcaaattccgtcctggaaccgatgatggcgactatcaggtcaaactacgcaacctgattcgctttctggaagaaggcgataaagccaaaatcacgctgcgtttccgcggtcgtgagatggcgcaccagcagatcggtatggaagtgcttaaccgcgtccgtaaagacctgtgtgaagatctggatttggccattgtcgaatccttcccttcgaagatcgaaggccgccagatgatcatggtgctcgctcctaagaagaaacagtaggctttcaagtaacactaaccgcgcagcgtttcgcgctgtgcggtgaactgttcgcctgtctgggtcatgttattaacaatgcgaagtggatatttttaaaatgccaaagattaaaactgtacgtggtgcggctaagcgtttccgcaagaccgcttctggcggcttcaagcgtaaacacgcaaacctgcgtcatattctgaccaaaaaatctactaagcgtaaacgtcacctgcgccctaaaggcatggtgtcaaaaggcgatctgggtctggtaattgcctgcctgccgtacgcataagtaattttttcattaaatcagaatattaaacaggagagctaaatggctcgtgtaaaacgtggtgtagttgctcgcgcacgtcacaaaaaaatcttaaaacaagctaaaggctattacggtgcacgttcacgtgtttaccgcgttgccttccaggctgttatcaaagctggtcagtatgcttaccgtgaccgtcgtcaacgtaagcgtcagttccgtcagctgtggatcgcgcgtatcaacgcagcggctcgtcagaacggcatgtcttacagccgtttcatcaatggtctgaaaaaagcagccattgagattgaccgtaagatcctggccgacatcgcagtattcgataaagtggcattctctgcactggtcgaaaaagcgaaatcagccctggcgtaagtcagatggaaaagggagcttgctcccttttttattgcctgtaacttacgcaaaagattgacatttccggcgctgagcatttcaatagaccccctgtatcgcatgacaaggtaaccgcaagcatgaacgctgctattttccgtttctttttttactttagcgcctgacatccaggggcttttgcgcataagaaaagaaacgaaaaatcgcgctaaaagcctccctcgtggaggcttttttgtttctggcgctagcatattggaccggcaggtcccaacgagaaactgaccagcctgactggaaaaagaggaaactatgtcccaactcgcagaactggtggccagcgccacggcggccatcgacggggcgacggatatcgccgcccttgacgcggtgcgcgtcgaatatctgggtaagaaaggacatctgacactgcagatgactacgttacgcgagctgccagccgaagagcgcccggcagcgggtgcggtaatcaatgaagcgaagcagcaggtcaccgagcgtctgaatgcgcgcaaagatgccctggaagctgcggtgctgaatgcccgtctggctgaagagaccattgatgtctctctgcctggtcgtcgcattgagaatggcggcctgcatccggtgacccgcaccatggatcgcattgagaccttctttggtgagttaggctttggcgtcgtaaccggtccagaaattgaagatgattatcataacttcgatgcgctgaatattcctgcccatcacccggcccgtgccgatcacgataccttctggtttgacgccacgcgcctgctgcgtacccagacgtccggcgtgcagatccgtaccatgaaggctcagcagccgccgattcgcattattgcgccgggccgcgtctaccgtaacgattacgatcagacccataccccgatgttccatcagatggaagggctgattgtggataaaaatatcagctttaccaacctgaaaggcacgctgcacgatttcctgaacaacttcttcgaagaagatctgcagattcgtttccgtccttcctatttcccgtttactgagccatcagcagaagtagacgtcatgggtaaaaacggcaagtggctggaagtgctgggttgcggcatggttcaccctaacgtgctgcgtaatgtcggcatcgatccggaagtctactccggtttcgcctttggtatgggcatggagcgtctgaccatgttgcgctacggcgtgaccgatctgcgtgccttctttgaaaatgatttacgtttcctcaaacaatttaagtaagggcaggatatccaatgaaattcagtgaactctggttacgcgaatgggtaaatccagccctggacagcgctgcgctgtctgaacaaatcactatggccggtctggaagttgacggcgttgatccggttgccggtgcgttccacggcgtcgtggtcggggaagtggtggagtgcggccagcacccgaatgcagacaagctgcgtgtgaccaaaatcaatgtgggcggcgatcgcctgctggatatcgtctgtggcgcgccgaactgccgtcagggactgaaagtcgcggtcgccaccgtcggcgccgtgctgccaggtgatttcaaaatcaaagcggctaaactgcgtggcgagccgtctgaaggcatgctctgctctttctccgagctggggatttccgacgaccacaacggcatcatcgaactgccagccgatgcgccgattggcaccgacatccgcacctacctgcagcttgatgacaacaccattgaaatcagcgtcacgcctaaccgcgctgactgtctgggtctgatcggtatcgcccgtgatgtcgccgtccttaacggtttgccactgaacgtgccggagatgcagccggtcgctgcgacgctgaacgacactttcccgattcaggttgacgcgacagaagcctgtccacgctatctgggccgtgtagtaaaaggcataaacgttaaggcgtcaacgccattgtggatgaaagagaagctgcgtcgttgtggtattcgttctatcgatccggtggtggatatcactaactacgttctgctggagctgggtcagccgatgcacgccttcgatctcgaccgcatcgacggcggtatcgtggtgcgtatggcgaaagagggcgaaaagctgacgctgctggatggcactgaagccagcctgcagagtgataccttagtgatcgccgatcatcagaaagcgctggcgatggctggtatctttggtggcgaacattcgggcgtgaacggcggaacgcagaatatcctgttcgagtgcgcttactttgatccgctctctattaccggccgcgcccgtcgtcatggtctgcataccgacgcgtcacatcgctacgagcgtggtgttgatccggcgctgcaacataccgcactggagcgtgctacccagctgctgctgtcaatctgcggcggtgaagcgggcccgatcatcgatcagacccatcaggcagccctgcctgtgccagcgacgatcacgctgcgtcgtgaaaagctggaccgtctgattggccacgtgatcgcggatgagcaggtgactgacattctgacgcgtctcggctgtgaagtgactgtgggagaagggcagtggcaggccgtcgccccgagctggcgcttcgatatggcgattgaagaagatctggttgaagaagtggcccgtatttatggctacaacaacattccggatgtgccggtacaggcgggtctggtgatgactcagcatcgcgaagcgaatctgtcgctgaagcgcgcgaaaaacctgctggtggacaagggctatcaggaagcgattacctacagcttcgtcgatccgaaaattcagcagctgctgcacccgggtgaagaggcgcttttgctgccgagcccaatctccagcgatatgtcgaccatgcgtctctcactctggaccggcctgctcagcgcggtagtctacaaccagaaccgtcagcagagccgcgtgcgcctgtttgagagcggcttacgctttgtgccggatacccaggcagatttgggcatccgtcaggatcttatgctggctggcgtcatcagcggtaaccgcgttgaagagcactgggatctggcgcgtcagacagttgacttctatgatttgaaaggcgatttagaatcgctgctcgatttaaccggcaaactggatgacatcagcttccgtgctgaagcgaatccggcgttgcatccaggacagagcgcggcgatttatttgcatgatgaacatatcggatttatcggcgtggttcatcctgagctggaacgtaagcttgatctcaatggccgcaccttagtctttgaactgctttggaataaggtcgcagaccgcgtcctgcctgacgcgcgcgagatttctcgcttcccggcgaaccgtcgtgatattgccgttgtggtggctgaaaacgtccccgcagcagatatcatcgcggagtgtaagaaagttggcgtaaatcaggtagttggcgtaaacttgtttgacgtgtaccgcggtaagggcgtttctgagggctacaagagcctcgcaatcagcctgattttgcaggataccagccggacactcgaagaagaggagattgccgcgaccgttggcaaatgcgttgcggcattaaaagagcgattccaggcaaccttgagggattgaacctatggcgcttacaaaagctgagatgtcagagtacctgtttgagaaactcgggctgagcaaacgcgatgccaaagagttagtagagctgtttttcgaagaggtacgtcgcgctttggagaatggagaacaggtaaaactgtctgggtttggtaattttgacctgcgtgacaaaaaccagcgtcctggcagaaacccgaaaacgggtgaagatattccgattactgcgcgtcgcgtagtaacgttccgcccaggacagaagctgaaaagccgcgtagagaacgctacacccaaagagactgactgaatttcagcgtttcaaaaaggccgcgcaagcggccttttttcatggtttcagtacgcagtaatcccgcttcccgcgcccgttaatctccctgacggcaaagagcaaaccgcctcatctgcctttcttttttctgcaatccctctacaatcaaatctctgttttctcagctaatcccgcttatgtctctgctcgaccagctcgcgcgccaggccgaccagcgcggccagaaatggcttattgtgttagcacttatgctctctgcactgctctgtctcagcctgtgtgccggtgacagctggatcgcgccctcagactggttcacggaaagcggcaggctctttgtctggcagttgcggctgccccgcagtctggcggtggtgctggttggagcgtcgctggcggtatgcggtgtcgtgatgcaggcgctgtttacaaatccgctggcggagcccggcctgctcggcgtctcgaacggtgccggtattggcctggtgctcggcgtgctgctgggcagcggttcgctgtggagccttgggctggcggcgatggccggtgcactgataattacgctcatcctgctgcattttgcccatcgtcagctctcggtcacccggctattgcttaccggcgtggcgctggggattatctgtagtgccatcatgacctgggcggtctacttcagtaccagcctcgatctgcgccagttgatgtactggatgatggggggcttcagcgggattgactggcgctatggctggatgatgctggcgctgctgccggtgatgctggccctgggggcgaccgggcagattcttaatctgctggcgctgggcgagacatctgcccgccagctcggactgtctctcttctactggcgtaacctgctggtgctggccatgggctggctggtcggcatcagcgttgcgatggccggtgctattggctttatcggactggtgatcccgcatctgctgcgtatgagcggcatcagcgatcaccgctatctgctgccggcatcggcgctggctggcgcaggtgtattactggcagccgatattgtggcacgcctggcgctgacgtcggcggaattaccgataggcgtcgtgacggcgacactgggcgcgccgctgtttattattttactggtgaaatcttcacgctagcttcggctggcgactctgcatctacaacagcatccacaacaggaaacagcatgaacatatatcaaactgaactggttacgctcgatggggaaaaaaccacgctgtcacaatggcagggcaaggtactgctggtggtcaatgttgcctcgaaatgtggtctgacgccgcaatatgaagagctggagaacctgcagaaagcctggcaggatcagggcttcagcgtactcggttttccctgcaaccagtttctggagcaggagccgggcagcagtgaggagattaaaaccttctgcagcaccacgtatggcgtcacgttcccgatgtttgccaaaaccgaggtgaatggcgcaggccgtcatccgctctatgctcagctgattgcggcccgacctgacgcggtgcgcccggaaggcagcggcttttacgagcgcatggagagcaaaggacgcgcgccgaaagagcagggcgacatcctgtggaacttcgaaaaattccttattggccgtgacggcagcgtgatccagcgttttgcacctgacatgacgccggaagatccgatcattctggaaaccattaagcaggcgctggcaaaatagatgctgttgcgcctgcaacaggcagccgtccccggacggctgctgccactgaccggtgagcttgccgccggtcagctgctgcacgtggcaggcccgaacggtgcaggcaaaagcaccttactcagtgtgattgcgggactgcaacccgcctccggcacggtgctgctggacgaacagccgctgagtgactggaacggcgcggcgatggcccgggttcgcggctggctgcctcagcagcaggcaccgctgagtcagatgccggtctggcactatttgcgtctgcatctgaaacaggcggcggggcagacagacgatcgcctcagcacgctgctgaaacggcttcagctgcaggataagttatcgcgttcactgacccggctctccggtggtgaatggcagcgcgtcaggctggcggcggtctgtatgcagattgatccccacatcaatccacacgggcggctgctgatccttgatgagcccatgaccgcgctggatatcgcccagcaaaaagcggtggacgatctgattgccgacctgtgcgcggcgggcatcagcgttatcgccagcagtcacgacctcaaccacagcctgcaacaggcggatcgggtctggctgatggataagggagcgttgattgcgcagggtgaaccggctgaggttctgacgccgcagcgcctgacaccgatctaccagattgctttccggcagcttgaacttgaaggacgcacgctgctgaccgtattgccctgacacttgctacccggcgggctttaccgctacattaagccggttgcaacttctgataaggacatttggcgatgcgcctgggtttgctgattttagttctgctgctgacgggatgcagtcatcacgctccgccgattaatggccgtctttccgattcgatcaccgtgattgcggaactgaacgatcagctcggtaactggcgtgggacgccttatcgctatggcggcatgagtcgtaacggggttgactgctccggctttgtctatctgactttccgcgataaatttgcgctgcaactgccgcgcactacctcagctcaaagcgatatcggcacccgaatcagcaaagatgaactgctgccaggcgatctggtcttcttcaaaaccggtcgcggggagaatggcctgcatgtgggcatttatgacaccgataatgcttttattcatgcctcaaccagccagggcgtcatccgctcctcgctcgacaatgtctactggcgaaaagtgttctggcaggcgcgtcgtatttaaacgcaggtccggggaatcagacttaagtccaattttaaatagagttaaaacagagagtaaaaggtttattttaaatgacagttattgagcgtgggttttaataaatataataaacgcttatttaattccactaataaccgctgttttatcgctactatttggcttaagggtgatcgcctgctgccaaacggcaatggaagagtaaagaagttcgtctcttcaatgatttggcactattgcctgcgcctgaccattactatacgatatccccatcgccgcatattctggcattaaaatgaaaattcatctttcggccgactatcagtcggaaatctggttttatcctgtctgtgatgttaatgggcgactgaccgctgtcgagctggtcacgcagtttgtgcatgaaagtgcccccatcaccctgccgcaggatctgttgctgccgcagctcgatgagtcgcagcagctgcgcctgctgcaaagtcagattggattgctggagcagaatcgcggcttttttgaagcgcattccgtgtcagcatttatacgtattgatgaaggcatggcccggacgctgctggccagcgaattagtgatgcgcaaaataaagcagttgccattcattctgttgaatatcactgaaacgtttccgcaactaaaactgggaaaaaataatcccctgctggcaagcctgcatgctgagtttaatttagcgatttctcatttcggcgcgggtaagaccccctctaatgcggtctacgataatttattcagctgcatctgcctggacaaagagtttattcattcgctggcaaagcgcgcttcattcgtgccatttattcagagcattatcgataatttccgcgcccattgtgaccgcctcattatttgtggcattgatgacgacgtgctgctggataaagtcagccagctgagcggtgccgagtttcagggtttcgctcttcccggtggtaaaatctgacgcgctgcattcactgatctgcgccgacgatcgtgtgccatccgcgcagcatcccggctgatacttcctgttaatccccgctatcagcgttacactagaggactaaccttaagtaacgctgagcatcgcatgggagaaacaatgtcctcaggcaaggcctctttcgacaacacctggttccgtgaacttaccgggtgttacaccgcgctgaaccccacgccactggcaggcggacgcctgctgtatcataacgcaccgcttgcagcctcaatggggctggatagcgcgctctttgccgataagggtcatgccgtctggcacggtgccgcactgctgcccggcatgcagccgctggcgcaggtctacagcggccatcagtttggcgtctgggcgggccagcttggcgacgggcgcggcattctgctgggtgagcagcgtctggaggatggcagcaagctggactggcatctcaagggcgcaggcctgacgccttattcccgcatgggggatggtcgtgccgtgatccgttccagcgtgcgtgagtttctcgcctcggaagcgctgcatcatctgggcattcccaccacgcgtgcgctgacgctgtcgataggtgatgagccggtctaccgcgaaacaacagagcgtggcgcgatgctgatgcgcatttcaccgagtcatctgcgtttcggtcatttcgagcatttcttttacagccagcagcaggagaaagtgcagcaactggccgactacgccattcgccatcactggccgcatctggacgctgaagcagaccgctatcaacagtggtttaccgacattgtgttacgcactgcgcgtctgattgcgctgtggcagagcgtgggctttgctcatggagtgatgaacacggacaacatgtcgattctgggtctgaccatcgactatggcccctttggttttctggatgattatcagcctgacttcatctgtaatcacagcgactatcaggggcgctacagctttgaaaatcagccaatgatcggtatgtggaatcttaaccggctggcacatgcgctgtcgggtctgctgaccaccgagcagttgcggacggcactgagcgcctacgaaacctgaactgatgcgggtctggggcgaacggatgcgggcgaaactcggtctgctgacgcagcagagcagcgataatgagattctgaccgatctgctggcactgatgacgcaggagcatagcgattacaccctgacgttccgcctgcttagtgagacgcaacaggctgacagccgttcaccgctgcgggatgagtttatcgatcgtgaggcgtttgatagctggtatcagcgctaccgcagccgtctgatggacgagcaggtcagcgatgcagaacgccaggccgtgatgaaggcggccaatccggcggtgattctgcgcaactatctggcgcagcaggcgattgaagaggcggagcggggagagcagggggagctggcacgtctgcatcaggcgttagagcaaccctttagcgatcagacagccgctgaatatcgtcagcggccgccagactggggcaaaaccctggaagtgagctgctccagctgatgcagactcagaggcggtgagaaaccgcctcggccagcagggcgagcaccttttcgctctcctgccagccgaggcagggatcggtaatcgacttgccatagaccagcggttcgccgctgacgactttctgattgccctcttccaggaagctttcaatcatcacaccagcaacggcctgcgatcccgctttaatctgttctgccacctctgccgcgacatccatctgacgacgatgctgcttcaggcagttaccgtgactgaagtcgatcaccagctgctgtggcagattaaacgccgacagactttcggctgcggcggcgacatcactggcatgatagttaggctgtttgccgccacgcaggatcacatgaccatgcgggttgccgctggtctgatagatagtcatctggcccagcttatcgggcgagaggaacatgtggctggcgcgcgcggcgcgaatcgcatccacggcaatctgtacgttaccatcggtgccgtttttaaagccgaccgggcaggagagggccgatgccatttcgcggtggatctggctttcggtggtgcgtgcgccaatcgcgccccagctaatcagatcggcaataaactggccgatcaccatatccaggaattccgtggcggtaggcaggcccagcgcgttgatatcaatcagcagctggcgggcgatgcctatgccgcggttcacatcgtagctcccatccagatccggatcggagattaaacctttccagcccactacggtgcgcggcttttcaaagtaggcgcgcatcacaatctccagccgatcttcatagcggcggcgtaacgcgttcagacgctcagcatattccagtgccgctttcgggtcgtgcagcgagcaggggccaatcaccaccagcaggcggggatcttcacccgtcagaatacgggcaatacgtttacgggcagcggtgacattgtcggcaattgccggagagacaggatgctcggccgccaggctggcgggggtaatcagactaccaatgcgtgcggtacgcagttcgtcggttttgttcatgggtttctcgaaaacggttcttcgcagcggtgaaataccgggaagtgatggtggtcacaataaaccattagtctgcgaattcaacccggaatttaataatgaaatcaaaagcgacggcagcgccgctttacagttcagcgccagttacccatcagtacatgcggcgagtcaggcccataatgtcgagaattttggtcgcaatctcctccacggagtagttggtgctgttgagatagcggatctgatgagtgcgaaacagcgcttccacttcgcccacctccagccggcactgacgcatcgaggcgtaacgggtattttccgcccgctcctgacgtatcgcagccagccgtttccgggtcgatggtcagcccgaacagtttattctgatgcgcgcgcagcgcgggcgggagtttaaggttatccatatcgtcggcaatgaatggatagttggcggcgcgaataccaaactgcattgccagatagaggctggtgggggttttgccacagcgcgagacgcctaacagaatcacctgcgcatcttccagtccgcgcagcgagatgccgtcatcatgcgccagggtgtaatcgatggccgcgatacgtgcgtcatatttacccaggttactggcatccagtccatgggtacggtgtgccaccggcgcgggcgataaccccagctcctgctgaagcggggcgaccagcgcctggacgatatcctgacaaaagccgtcactctgtacgatgatgtcgcgcacttccggcgtcacgatggagaaaaagaccagcggccggacaccgctctgctgatagagcgcgttaatctgggctttaaccgccagcgcccgctgaacattttccacaaacggcagcgtcaggctggtgatattgaccggaaactgcgacagcaccgcatgacccagcacctcagccgtaatggccgtaccatcggagatataaaaaacgcttctgtcagttgtcataacgaaatcagcctcagacaagagtgagcattcagcatgggccatgcaattaaataaatcatctctgattttaatttctggaatgtctgtccggattatttgtctgtcgtttcatcacgatactaaaaatgaaagggtggctcgttgagccagcattctttttaatctgtcgttaagccgcaagtagccacgcagttgttgcgcaacaaaacagaatgcttaagtggctgaaaatctgccatttcctgtggcatcaatcatttagagaaaaaaggcgactttgcgcaacagcaaaataatgcgctcacaattccgaaactgtggctgaaattctgctttaacgattcaacagatcgttattgagagggtgatatgccaggctgaagacagattactccctgtgtccattcattgataattgataaaggataagctcaatgtccagtaaaggcgaacagccactcgtgctctggtataaccagcttggcatgcatgatgttgaccgggtggggggcaaaaatgcctctctgggtgaaatgattactaatctgtcgtcgctgggcgtttccgtgcccaatggtttcgcgaccacatcctacgcctttaacctgttcctcgatcaaagcgggctgaatcagcgtatttatgcgctgctggatgagaccgatattgatgacgttgatgcgctggcaaaagcgggtaagcagattcgtcagtgggtcgtggagacaccgtttcctgcccgagctggagtccgccattctggacgcctataagcagctttctgctgatgatgatgccgcgtcgtttgccgtgcgctcctctgcaaccgcagaagatatgcctgacgcctcttttgccggccagcaggaaaccttcctgaatgtacagggcatcgacgccgtcatggtggcggtaaagcatgtcttcgcctcgctgtttaatgaccgcgctatctcctaccgtgtgcatcagggctatgaccatcgtggcgttgcgctctcagcgggaatacagcgcatggtgcgttcagacctggccgcctcgggtgtgatgttcaccattgataccgagtccggctttgatcaggtagtctttatcaccgccgcactggggctgggggaaatggtggtgcagggtgccgttaacccggatgagttctatgtccacaagccaaccctggcagccgatcgtccgtcgattgtgcgccgcaatatgggctcgaaaaaggttcgcatggtctatgccgattcccaggcgcatggcgagcaggtgcggatcgaagatgtgcctgaggccgaacgcgaccgtttctgcctgagcgatgaggaagtgcaggcgctggcgaagcaggcggtgctgattgaacagcactatcagcgcccgatggatattgagtgggccaaagatgggcacaccggcaagctttttatcgttcaggcgcgccctgaaaccgtacgttcaaatggtcaggtaatggagcgttatacgctgcaggggcagggcagcgtcgtcgtggaaggtcgtgctatcggtcatcgtattggcgcaggcgtggtgaaggtcatccacgatatcagcgaaatgaaccgcattgaaaaaggcgatgtgctggtgaccgacatgaccgacccggactgggaaccgatcatgaaaaaagcatcagcgattgtgactaaccgtggcggacggacctgtcatgctgcgatcatcgcgcgtgagctgggcattccggcagtggtgggctgtggtgacgccaccgaccggctgaaagaggggcataacgtcacggtctcatgtgccgaaggtgataccggctacgtctatgatcaactgctcgacttcgacgtcaccagttcgcaggtcgattcactgcctgaactgccgctgaagatcatgatgaacgtgggcaaccccgatcgcgcctttgatttcgcctgtctgcctaacgaaggcgtgggtctggcgcggctggaatttatcattaaccgtatgatcggcgtccaccctaaagcgctgctggagtttgaccaacagacgccggagctgcagcagcagatccgtaaaatgatgaaaggatttgatgatccggtggagttttacatcgctcgcctgactgaaggaattgccacgcttggcgccgcttttgcgccgaaacgcgtaattgtccgactttctgactttaaaaccaatgaatatgccaacctggtgggtggagaacgctacgagccggaagaggaaaacccgatgctgggattccggggtgcgggtcgctatgtcgctgacagcttccgggactgctttgcactggagtgcgaagcggtgaaacgtgttcgcaacgagatgggcctgacaaacgtcgagattatggttccgtttgtgcgcaccgttgagcaggcgaaggctgtggtggaagagctggggcgtcagggactgaagcgcggcgagaacgggctgaagatcattatgatgtgcgagatcccgtccaatgccctgctggcggatcagtttcctggagcacttcgatggcttctctattggctcaaacgacatgactcagctgacgctggggctggaccgcgactctggcgtcgtctccgcgctgtttgacgagcgtaacgaggccgtgaagatgctgctttcaatggccataagggccgcgaagcagaaggggaaatatgtcggaatctgcgggcagggaccgtcagaccatcaggatttcgccgcatggctgatggaagagggcatcgacagtctgtcactgaacccggacacggtggtggagacctgggtgagtctggcgcagttaaataaaacagcctgatacgggttgttagcactcttcagggcccgctatgcgggccttttctgtttatatctggtcagattcaggcaaaaaaaaagcccatcacaggggatgggcaaagactacacacagcaattctttactctactcaggggaatgagattgtctgaaaatcatcaggttgatttcgaacataggaaacatgttattcatacggctggctgtcgtctttaagaatcctcttattagtttaaagccaataatcttttgtgacctttacttcgccatttggcttaagaaacagtgcagaaagtaatcttttttggcccgaaaaggtcactttcaggccaaaggtggcttttttcttaaaaatcgctaatggaaaacagaatttatctgatctgagagaaggggtgcggttaatcatcattaaccgcactaatcaatgcttatgggggctagcggcgcagcgggttgttgcatctcatcatacagcaggcggggtatcctcgtgatccgccagggcatcagccacggccagttggtcactatccggggcaggcgcttcatgaacccagacggaaaccagacggtaggagaccgccagaaccaccggcccgataaacagaccaatcatcccgaacgcaaacagtccaccaataacaccagaaagaatcaggatcattggcagatcggcacccatacggatcagcatcgggcgcagcacgttatccatcgtgccgaccacacagctccagaccagcagcaccgttccccatgttgtatctccgctccagtagaggtagataatggcgggaaccagcaccagtagcgggccgagctgtaccagacagcagaggatcatcagtaccgtcaacagcgtggcgtaaggaatgccggagatcgccagaccgataccgcccagcacgccctgtaccagcgccgtcactactacgccaagcgccacggcacgaatcgactgcgccgccagcagtacggcggcatcaccgcgccgtcccgccatgcggaaagcaaagtgacgaatgccctgggcagcctgtttcgccacgccagtaaagcagcacgctgaacagtaacatcacgcccagatggatcataaagcgtccgaaatgaccggcctgcgcgacaaaaaagccggtggtacggccgatatagggctgtattttcgccatgacgccggcaccgccgctcgccaccagcgtgtcataactgacataaagcttcttgccgaccatcgggacatcgttgagccataacagtcgcggcatcatatgcccctgggtaacccaggcaatcaccggcgcgctgttatcaatcaggctgctgaccagcagggcgatagggataataaacagcagcagcagcagcagtgtcatcacgatcaccgccagggaacggcgtccccataacagtcgctggaatttcagcatcaatggccaggtggcaatcaccaccatgctggcccaggcaaagcccagaataaacggctgcacgacccataaacaggcgacaatcagcagcaagatgaacatcagggtgaagagtatttgcggtaaatccatatcccggtactggcttttcatcattgactcataacctcgtcttaatccttcattttcaggcattcggatgcccgtttttatcatgatctatttgctgaggtttaaacagagttgcggagaaaggtttttgccttttctgaaaaaagggcaggcgcaggaaaaatatgataaaacgagaaatcgctaatctataaacgcaaacgtttacaacaccttcggtcagacaatcatgatcccacagatttcgcaggcaccgggcctcgttcaactggtgctgacgttccttgagtcgttgaaagagcagggttttaccggtgacatggcaaccagctatgccgatcgtctctcactctccaccgataatagcatctatcaattgctgcccgacgcggcgctctttccgcgttcgactgcggatgttgcgctgctcgcccgcgtggccggagaagcgcgctttgccagtctggtatttaccccgcgcggcggcggtaccggcaccaacggtcagtcgctgaatcaggggattgtggtggatatgtcgcgctacatgaaccgtatcctggagatcaataccgatgagggctgggtgcgggttgaagcgggggtgatcaaagatcagcttaacgcctggctgaagccattcggctttttcttctcgccagagttatccaccagtaaccgtgccacgctgggcggcatgattaataccgatgcgtccggccagggctcgctggtctatggcaaaacctcggaccatgtgttgggcctgcgcgccgtgctgctgggcggcgatatccttgatacgcggccaatggccaccgcgctggctgaaaccctggcgcagacggcgacgcccgaaggccggctctatcagcaggtgctgacgcgctgccgcgagcatcgtgcgctgattctggaaaagtttccaaagctgaatcggttcctgaccggatatgacctgcgccatgtattcagcgacgatatgcaaacctttgacctgacgcgcctgctgtgtggtgcagagggaaacgctggccttcgtcacggaagcgcggcttgatatcacgccgctgcctaaagtgcgccgactggtgaatatcaaatatgactcctttgactccgccctgcgcaatgcgccttttatggtggaagcgcaggcgctctcggtagagaccgttgactctaaggtgctgaacctggcgcgcgaagatattgtctggcactcggtgcgtgaattgatcgccgatgtacccgacaaagagatgctgggtctgaatattgttgagtttgccggtgacaacgccgcgctgatcgatcagcagattgaacagctttgtggccgccttgacgcactgatggcgcagcagcagggcggcgtgattggctatcagttctgtaacgacctggatggcattgaacgcatctataacatgcgtaaaaaagcggtgggtctgttgggaaatgccaaaggccgggctaaaccgattccctttgtggaagataccgcggtcccaccggaaaaactggcggactacatcgtcgagtttcgcgcgctgctcgacagccacgggctgagctacggcatgtttggccatgtcgatgcaggcgtactgcatgtgcgtccggcgctggatatgtgtgatccgcagcaggagatgatgatgaagcagatctccgacgaagtcgtagcgctgacagcgcgctacggcggcctgctgtggggtgaacatggcaaagggtttcgagcccagtacagtccggcattcttcggtgagacgctgtttaacgaattgcgccgcatcaaagcggcctttgatccgctcaatcgcctgaacccgggcaagatctgtacgccatacaacagtaatgataaaatgatgcaggtcgatgcggtgaagcgcggaacctatgatcgtcagatcccgttaacggtccgggatgaatggcgaggcgcgatggagtgtaacggcaacgggttgtgttttaactttgatgcccgcagcccgatgtgtccctccatgaagatcacccgcaaccgcattcactcgcccaaagggcgggcaacactgacgcgggagtggctgcggctgctggccgggcagggcgtcgatccgctcaccctggaaaagcagctgcctgaaaatcggctgtcgcttcgcaccctgattgcccgtacccgcaatagctggcacgccagcaaaggggagtatgacttctcgcacgaggtgaaagaggcgatgtcgggctgtctggcctgcaaagcctgctctacccagtgtccgattaaaattgacgtgcccgctttccgctcgcgcttcttacagctctaccatacccgttatctgcgtccggtcagcgatcacctggtggctgcagtggagggctacgcgccgctgatggcaaaagcaccgaaagtgtttaacttcttcctgcgccagccgtggctgaaagagataagtaaaacccatatcggtatggtcgatctgcctctgctttcggccccaaatctgaaacagcagctcagtggtcatcccgccatgaacatgacgctggagcagctggaagggctgtcagccgctgaacgcgcaaactgtgtgctggtggtgcaggatccttttaccagcttctatgaggcgcagctggttaacgattttgtcaggctgattgagaaactgggctaccggcccgtgctcctgccattctcgccaaatggcaaagcgcaacatgtgaaaggtttcctgcaacgtttcgcccgcacggcgtcccgcaccgccgatttcctgaatcgggtggcaaaactggggttgcccatggtcggtgtcgatccggccacggtgctctgctatcgcgatgagtatcgtcagacgctgggcgaatcacgcggcgactttaacgtcctgctggtgcatgagtggttagagcgtgcactggcagagcgtgacgtgcaggccacgggcggagaatcctggtatctgtttgcacactgcaccgaggtgaccgcgctgccctccaccccgaatcagtggcaggcgatcttctcccgttttggcgcgaagctggagaacatcaatgttggctgctgcggtatggcaggcacctacggtcacgaaagtaaaaacctcgaaaactcgctggggatctacgcgctctcctggcatccccagcttcagcgcctgccacgccagcgctgcctggccactggctattcgtgccgcagtcaggtcaagcgtgtcgagggcaacggaatgcgtcatccgcttcaggcattgttagagctaatgtaaaaaaattgtgcgcgacgtcacgccctggctggattagaatatccagcctgcgtgacgcatgaagtcactttgcagcgcagtggcctggttccactccccgaccattgccagttgatggcagaggcgggtcagggacaatcgcgccagttgataagcctgaaggcgaaacaggcgatcgcgatcgctgtttcccatctcctgcaccagtcggtgatgcagtttacccatggcatgcaggtaactctggtcgtcaccgttcaactggcagatttctgccatatcctgacaggcatcgttaaactgacgtagctgatgaatcgtgcagtcggcccggtcgagctttgcctgcgccatataaaagtcgacggtgatatcacgcaccgcaaactgatattcgtcgattttgtgctgcagccaggctgagacagaaagcgtcataacgccaccctgaatgtgaatgataataattatcatatttaattgagctgtgattgcaattggcgggcagaaaaatttatcgatttatcctgcctgtcggtataatcggaaataacaatctgtttacatcgcagaaaggcgtaacctatcaataagcatttttatcaaaaatggttatttaaaaaagagtgatttattaataggttaacactggcttatttatgctgacgcgctcaccacaaggtgagctgaagaggctatgcttaataattaagcaaataaaaccgcacaagatgattatccctgcaaaacaagaggttgaagtgattggtcagatcactaccatagggggatagcctgaaaaggtccggactcaagaggtatcaacatggcatccgttaatacagactctttctcacccgacgattttgtctggaaagggctgacgctgactgaaaccgcagcgcaacaaattctcaatctggcggctcaggaccccgatgtcaagggtctgcggctcggcgtaaaacaatccggctgcgccggttttggttacgtcatggatctggtgaaagagccagtcgaggatgatttgcagttctcattccatggcgcaacgctgtttgtgccgctacaggcgatgccattcgttgatggcaccgaactggactacgttcgtgaaggcctgaatcagatttttaaattcaataaccctaaagctcagcacgcctgcgggtgcggtgagagctttggcgtcgagtaagtgaaatatgtcacgacacagcgaaacatctgacgatgtacaaatctgggaaggcaagctcaactacaaagagggcttctttacccaactgcaaaccgaagaatttgccaacggcatcaatgaagatgtggtgcgggcgatttcggccaagcgtaacgagccagagtggatgctggagtttcgtcttaaagcgtttcgtgcctggcttgaaatggaagagccacactggctgaaagcgcactacgaaaaactcgactaccaggattacagctactactccgcgccttcctgcggcaactgtgatgacagctgcgcatcagaacccggtgcactgcaggcttcaggcagcgcgccagccagcgattatctgacacaggaagtggaaaacgcctttaatcagctgggtgtcccggtgcgtgaaggccgtgaagtggcggttgacgccatttttgactccgtttcggtggcgaccacctatcgcggcaagctggcggagcaggggattatcttctgttcctttggcgaagcgatccaggagcacccggagctggtgaagcagtatctcggcacggttgttccggcgaacgataacttctttgcagcgctgaactcggcagtcgcctctgacggcaccttcgtttatatcccgaaaggggtgcgttgcccgatggagttgtcgacctatttccgcatcaacgcagcgaaaaccggtcagttcgaacgcaccatcctgattgccgatgaagacagctacgtcagctacatcgaaggctgttcagcgccagtgcgtgacacctatcagctgcacgcggccgtggtggaagtcatcatccacaaaaatgccgaagtgaaatattcgacggttcagaactggttcccaggcggcgaaggtgaggggggtatcctgaacttcgtgaccaagcgcgcgctgtgtgaaggtgaccacagcaagatgtcctggacacagtctgaaaccggctctgctatcacctggaaatacccaagctgcattctgcgcggggactattcggtgggtgaattctactcagtggcactgaccagtggtcgtcagcaggccgatactggcaccaagatgatccacattggtaaaaacaccaaatcgaccatcatctccaaagggatttcggccggtaaaagtcagaacacctatcgcgggctggtgaaaatcatgccaaccgcgaccaatgcccgtaactttacgcagtgtgactcgatgctgatcggtcctgattgcggcgcacatactttcccgtatgtggagacccgcaacaatactgctcagcttgagcatgaagctacgacatcacgtatcggcgaagatcagatgttctactgtctgcaacgcggtatcagtgaagaagacgccatctcgatgatcgtgaacggcttctgtaaagacgtattctcggagttgccactggaatttgctgtggaagcccagaaattgttagccatcagccttgagcacagtgtgggctgatgccgtcacacgcgttgccggaagcaatgtgaaggaataagtatgttaagcattaaagatttgcaggtcagtgttgaagataaagccattctgcgtggcctgaatctcgaaattaaacccggcgaagtgcatgccatcatgggcccgaacggctcaggtaaaagcaccctgtcagcgacgctggcaggccgtgaagattatgaagtaaccggcggtttcggtcagcttcaaaggtaaagatctgctggaactggcccctgaagagcgcgccggtgaaggcatctttatggcattccagtatccggtagaaattccgggcgtcagcaaccagttctttttacagacctcggtcaatgcggtacgcaaatatcgtcagcaggaagagctggatcgcttcgatttccaggacttcattgaagagaaaattgagctgctgaagatgccggcagatctgctgacccgctcagtcaacgtcggcttctccggcggtgagaagaagcgtaacgacatcctgcagatggcggcactggaaccagaactctgcatcctggatgagaccgactcaggcctggatatcgatgcgctgaaaatcgtggcgaatggcgtaaacagcctgcgcgacgaaaagcgtgcctttatcatcgtgacccactaccagcgtattctggattacatcaagccagacttcgttcatgttctgtatcagggcaaaatcgtgaaatctggcgacttctcgctggtgaaacagctggaggagcaaggttatggctggcttaccgacgaagagtgattctgcgctgcaacagtggcatcacctgtttgagtcgcgcggcgacgtgcgttctctgcaggcacagcagcactggcagcaactgatgcgcgttggcctgccaacccgcaagcacgaaaactggaagtacacgccgctggacaccttactgtcacagcagtttgtactgcctgacgcgccgcagaccctgagcgctgaacaggttgatgcactggcgctgccgctggatgcgatccgtctggtctatgttgacggtcagttccagccagccttcagcagtcgcgactgcgaactgtttgaggttcagcacagcgtggccgccgagcgccgtccgctgcctgctgcggttcagcctgaagtcttcctgcatctgacagagagtctggcagaggaggtgacgaccctgcgtctggcgcgcggtaaatccgctgcgcgtccggtctatctgctgcacatcaccagcggtcagcagacgggtatgaacacagttcactatcgtcatcacctgcagctggaagagagtgccgaagcggaagtgattgagcactacgtttcactggatgagcgcgcccatttcaccggcacgcgctttacctttgcggtaggcgacaatgcaaaactgacgcacacgaagctggcctttgaaagcagcgccagctatcactttgcgcataacgatctggtcattggcaacgatggccaggtcagcagcaccagcttcctgctgggtgccggactgtcgcgtcacaacaccagtacccagctgaacggcgaaaacaccacgctggcgatcaacagcctggtgctgccggtgaaacaggaagtggcggatacccgtacttacctggagcacaacaagggccactgcgtcagccgccagatgcataaaaccatcgtgcgcgacaaaggccgtgcggtgtttaacggccacattaaagtggcacagcatgcgctgaagacagacgggcagatgaccaacaacaacctgttgctgggcaagctctcagaagtcgataccaaaccgcagctggaaatttatgcggatgacgtcaagtgcagccacggtgccaccatcggtcgtattgatgatgagcagatgttctacctgcgttcgcgcggtattgagcaggatgctgcacagaccatgattattcatgcttttgccgcagaactgaccgaaacactggaaaatgaggtgatgcgtcaggccgtgctgcagcgtatcgcgcaacgttttcccggaggcgacatatgatgaacttcgatctcgaacgcgtcagggctgattttcctatcctgaagcgtgaggtcaacggtcatccgctggcctatcttgacagtgcggccagcgcacagcgtccactctcggtgattaacgccgagagtcatttctatcagcacggctatgcggccgtgcatcgtggtatccatacgctgagccagcaggcgaccagcgacatggagaaacgtgcgcgatcaggctgcccgttttatcaatgcgcagtcacaggaagagattgtcttcgtcaaaggcaccaccgaaggcatcaatctggtggcgaacacctggggcagcagtaacctccaggctggcgataacctgatcatcactgagatggagcatcacgccaatatcgttccatggcagatgctggcccagcgcaccggcgcagaagtgcgtgtcctgccattaaatgacaacggtgagctggcgctggagcaactggcggggctgatcgacagccgtacgcggttgctggcggtgacgcatgtttcaaacgtgctcggcacggttaatccggttaaggcgatcgttgctcaggcaaaagccgctggcgtggtaacgctggtggatggtgcccaggcggtgatgcatgacaaggttgatgtgcaggatatcggctgcgacttctacgccttctccagccataaactctatggccccaacggcgtgggtatcctctacggccgtaaagcgctgctggatcagatgccaccatgggaagggggcggttcaatgattgagcgcgtcatgctgcccaccggcaccacctggaacagtgcgccgtggcgctttgaagcgggtacgccgaataccggcggcattattggctttggtgcggcgatggcctatgtgcaggcgctgggactggatacgattcatcagcgcgagacggcactgatgaactatgcgctcgataagctgggcaccgttccggatatccagatctacggtccgcagtcacgagctggcgttatcgccttcaatctcggtaaacaccacgcctacgatgtcggcagcttcctggatcaatatggcattgccatccgcaccggacatcactgcgcgatgccgctgatgcagcattacaatgtaccggcgatgtgccgtgcctccttcacgttctataacagtgaagaggaagtggatcgtctggctgccggtttgacgcgcattcatcgtctgctgggcggctgaacagttttaacggagtcactgatggcgaatttgcctgaaaaagagaaactggttcgcaacttcaaccgttgcgctaactgggaagagaagtacctctacattattgagctgggttcaaagcttccggaatcttctgaaaccttgcaccagccggagaacgtgatttcgggttgtcagagtcaggtgtggatcagaatgaccccgcaggcggatggttccattgcgtttgaaggcgacagcgatgccgctattgttaaaggtttgattgctatcgtatttagcctctatcagaacctgccgcccgccgatatcctggcgctggatgtgcgccactggtttggagaactggcactgatgcagcacctgacgcccacccggtcgcaggggctggaggcgatgattcggtctattcgccataccgctcagaacctcagctaagttacactccacagacgccatccggcgtctgtttttttatctgacgagaaaattgcatgaaacctgctttacgtttagccggtgcattgctgctgacctgctttgggctctctgcacccgcgtttcgccaccgaatatccgctgccaccacctgacagtcgcctgattggcgaaaacgtcgtgactcaggttcctgacaataagcaacctctggaagcgattgcggcgcgctaccaggtcggcctgctgagcatgctggaggcaaatcccggtaccgatccctggctgcccaaagcgggcacccagctgacggtgccgctacagatgatcctgcccgatacgccgcgcgaagggattgtggtgaatctggccgagctgcgtctctactactatcccaaaggggaggataaggtcattgtctatcccatcggcattggccagctgggtgcggccacgccagtgatggtgacgcagatcagccagaagatccctaatcccacctggacgcccacggcgaacatccgcaaacgctacgccaaagagggcattacgctgcctggcgtggtccccgccggaccggataacccgatggggcagtttgccatgcgtctggcgcgcggcaccggccagtatctgatccatggcactaatgcgaaattcggcatcggcatgcgcgtcagttcaggctgtatacgtctgcgttcagaagatatcgaagcgctgtttaactcagccccgaaagggacgcgggtacagatcatcaatcagccggtgaagtacgctgtagagccggatgggaaacgctacgtggaagtgcatcagccgctgtcacgcaacgataaggacgatccacagaccatgccgattgcactcactgccggagtgaagcagtttatgaaaagtgagaagagtgatagtgcgctgattaaagccagcttagcgcgacgctcaggcatgcctgtgctggtcagcagtggggagccggtgcagagtgatacggtgccgcctgcagggctggagagcgcgtctgtgggggctgatagcccggtgacacaggctgatagcccggtgacacaggctgagggcaacgcggttcagccctgaaacggataagtgcctgtgaagggcactgaattcggagcaaaaaaaatggcgccataaaggcgccatttttaaaccagaactcttacttacggtaagagtgagcctggttgtccagacgctggttagcgcgtgctgcgtcatctttagcagcctgaacgtctgaacgcactgcgttcacgtcgttgctcagctggtcaactttagcgttcagagtctgaacgtctgaagacagctggtcgattttagcgttgcttgagcaaccagccagcatagttgaagccagaactaccgcgcccagtaccagtttagtacgattcattatttataccctctagattgagttaatctccatgtagcgttacaagtattacacaaagctttttaagttgagaataaatttttgatgagaagatgcttaaatttgatcgttcgctcaaagaagcagcgaatcacagaatatgataaaaaaatttagcgaaaacagagagatttaatcggattaaccttaatattaagagtatttgaatagttattttcgattggaattttctgacatttggtttaagtagaaataaaaaaaagcgcccgataaaggcgcttcaaaataatggtcagagagagttttacagtacgtgtacagaagcggtgttggtagttccgcttggtactaatgcgcctgacaccagtaccacgacatcgcctttctggccatagccactttccagcgccgcttctttacccagacgatagaaatcgtcggttgaagcgatctcagtcaccagacgtgtctcaatccctttgctcaggatcagctgacgggcagtcatcggattggtggtcagcgccaggatggtcgcgttcgggaaatatttacgtacggctttagcagatttacccccttcggtagcaaccacaatcagtggcgcttccagcttctcagcggtctctacagcaccacggcagacggcttctgtgatacgcattttgcggttatcactctggctgtcgatgcgggacttcatcacgcgatcggtacgctcacagatggtcgccatgatggtgaccgactccagcggataacggcctttggcgctctcacctgacagcatgacagcatcggtaccgtcgagaatggcgttcgccacgtcaccggcttctgcgcgggtagggcgcgggttcttgatcatggaatcgagcatctgggtagccgtgataaccactttgcgtgctttattacattttttgatcatcatcttctgcgcgaagatcacttcttcaaccgggatctcaacgcccagatcgccacgcgcaaccatgatgccgtctgacgcttcgaggatttcgtcgaagttgttcaggccttcctggttttcgattttggagatgatctggatatgctcgccgccgtttctgtttcaggtgctcgcgaatttccagcacgtcggaacgtttacggatgaaagaggcggcgacaaagtctacgccctgctcacaaccaaaaatcaggtcgcgtttatctttttcggccagtgctggcagctggatagagacgcctggcaggttaacgcctttgttttcgcccagatcgccgttgttcaggactttacacaccacggtattttcagtgacttcgatcacttccataccaatcaggccatcatcgaccagcaccgtgttgccgattttcaggtcagcagtgaagcccgggtaggtcaccgcaacgcgctcgctgttgccaatcacgctctggtctgtagtaaaggtaaaggtctgacccgctttcagagccgcatcgttgccgccttccagtttcatggtgcggatttcagggcctttggtatccagcagaatagcggcctgacggccggttttttgcataacggcacgcatgttggtgatgcgttggccatgctcagcgtagtcgccgtgagagaagttaagacgcataacattcatgccagcttcaagcagctgagtcagcatctcttcggattcggttttcgggccgattgtacaaacgattttagtctttttcatgacggattttctgtaagttgtgatggatgaataagggcggaatccgatggcagcgcatcgaagtgaaatttctgattgagactgaaatgggcagtactgagtaagaataggtgacgaaggccaggcgtgcagggaagttgtgcggttacggttggtaaccaccacgctgttgttgcgcaaatcatttgagttatcgcagtaagcacgtgatcgctgaaacctttcaagtaagcaacgcgggacagtatagacgctaagtatgcgaaaaccaatcaaaaagcagaagggggaagcgatgcagatcaataaaagtggagttgcgcaagctgaaggaattctgaaagtggtgcgctctaatggactcgaaccatcgacccccaccatgtcaaggtggtgctctaaccaactgagctaagagcgcatactgaatattggtgcgtccgagtggactcgaaccaccgacccccaccatgtcaaggtggtgctctaaccaactgagctacggacgcacttggtgcgctctaatggactcgaaccatcgacccccaccatgtcaaggtggtgctctaaccaactgagctaagagcgcaacatgctgtcagggcgacagcggggacgaatattaacggcagcgtgtgaggctggcaaggggaaaatagttttttcgccatgactgcacagcaactgtgctaaccgtcgtttttttcgtcattgcgggccatgaatgacccgcctcgaacgttatcgcgctgcacgcgtcaggataatttccgccggtgattgctgtaaccgtctgatgcgccatatcatcatcaccgcagccgaggtcaggccgataataaagccgcaccagaagcccgcaggtcccatgcgcggcaccacccagtcggtcagcgccagcagataaccggctggcagccccagcagccagtaagcgataaaggtaataaagaaaatcgaccgcgtatctttatagccgcgcaggatcccgctgccaatcacctgtatcgagtctgagaactgataaattgccgccagcaacatcagctgtgccgccagcgtcaccacttcagggttgtcgttatagagcagggcaatctgatgacggaacgtcacggtaaaaatggcggttagcgccgccatgctgatgcctacaccctgtgcggtccaggccgcgacccgtgcctgctcggtggagccctggcccagacgataaccgacgcggatggtggtcgcgacacccagcgacagcggcaatacgaacatcagtgaactgaaattgagcgcaatctggtgaccggccacgttaacgatgcccagtggcgaaaccagcagggcgacaacggcgaacagcgtgacctcaaagaagagtgccagcgccaccggcaatcccagcgtcatcaggcggctcagaatcggacgggaagggggtgaccagcggctctccatacggatatcgcgcatgctacccatccggcgcacccagaagcgcatgcagataaacatcacccagtagaccgaggcggtcgccacgccgcagccgacaccgcccagggctggcatgccgaagtggccatagataaagacatagttaagcgggatgttgaacatcaggcctaaaaagcccagcaccatgccgggtttggttttcgacagcccctcgcattgattgcggagcacctggaagaagaggtagccaggcgcgccgaaacagcagggcatgcagatagccttctgccttcagcgccagcactggatcaatgtcatgcatcgcccggataagataaccggcatgccacaacagcaccataatcagcagggagacgaaaaaggcgagccagtatccctggcggatctgttcaccgatgcgttcgcggcggccagaaccattgagttgcgcaacggtgggcgtcaatgcaagcagaagaccatgaccaaacaggatggccggtagccagacagaggtgccgacagcaacggcggccatatccgtggcgctgactgcgccggccataatggtatccacaaatcccattgcggtttgagccacctgagcaaggatgaccggaatcgcaagggccagcaattgacgcgcttctgttaaatacttctgcacgttaacacctgacttattgaatgaattaaaaggggcaggaagcccggggaatttcgcgagctagtgtaactggcgtaacagaattcgccaatctttgtcacacaatgcggtttgctccgctataaagcggcggtgcgggctgaaatctaacagccgacctgagctgtgataaactagcgtaaacttcgcagaggcaaagactatgtttaccggtattgtgcagggcaccgcagaaatcgtgtccattgaagagaaagaactgtttcgcacccacactgtccgcctgccggaagagctcttaccgggtctggcgctgggcgcatccgtagcccataacggttgctgtttaaccgtaacggcaattgaaggcgaccgcgtcagttttgatttaattaaagagacattgcgggtgactaaccttggcgatttacgtcagggcgatgtggtcaatattgagcgtgcagcgaaattcagcgatgaaataggcggacatctgatgtctggtcatattatgaccaccgctgaaatctgcaagattatccagtcagaacataaccgcgaagtctggtttaaaatccaggatgcggcgcagatgaaatatattctgcataaaggatttgtcggcatcgacggtatcagcctgacggtaggcgatgtgactaagactaagttctgcgtctatctgatcccggaaacgctggagcgtaccacgctgggggcgaagacctttggcgatcgggtgaatattgaaatcgatccgcacacgcaggcaatcgtggagaccgttgagcgggtgttagcacagcgcgatgccgcggcggcgatgagcatgctgaccggccagtcaacgacagagagttgataaaaggcgcgtaagcaccgcagacagcccaatcggttttactctgtcagcattataaaagcgcagggcgccgggtcagaagaggaaagcgtcccgccgcccggataaaaacgccgggagcgtttttgaacaacgcaaagcgttggcccggcaacgggcgtacctcagggatgaggtgcgtaatcgcgtgggccgggcgtgtcagggatgacgggttttgcgactttccgatctgaccccgttccttgcgcaacgctccctgttaaagcaaaacaggcccttcttttcaagtgttcagccggggcagcgccttcttaattgcccgctttttaacccctaccgcgccacccgtaatcccccctcaacaccgcgactgaacacgatctgccacagctgaatatcacgcgcccggaaggcaccggcacaggcattcagataataggagaacatccgtttaaagcgttcgccatatttatcggccagctctggccaggcctgcaaaaagcgttcatgccaggccatcagtgttttatcgtagtctgcgccgaagttgtgccagtcttccagaataaaatggggttcgctggcatcggccacatggcgcaccgaaggcaggcagccgttggggaagatatatttatcgatccagggatcgacactcatatcggttttaatcgcgccgatggtgtgaagcaggaaaataccgtcaggctttaaattacgatcgaccacgtcaaaataggtcgcgtaatttttcggtccgacatgctcaaacatacccaccgacacaatacgatcaaactgctcattcagatcgcgataatcctgcaacagaatcgtgacgtctaatccgctacagcgctgctgcgccagtttctgttgttcggcggaaatcgtcacgccatgcactttaacgccataatgacgtgcggcaaattccgcgagtccgccccagccacagccgatatccagcagtgacattccaggttccagcgctaatttacggcagatcatatccagcttggcttcctgcgccgtcgccagtgtcgtcgcctctttccagtagccacaggagtattgcatatagggatcgagcatcagtgaaaagaggtcgttgcccaggtcgtaatgctctttaccgacaatccacgcccgtttttttgactgcagattggttaagcgtgcggcggcaatgcgcagcgtatctttgaagtgatgaggcagctgctgatcgagtttatgtttaagtacctggtggaagaaaatatccagccggtcacactcccaccatccatccatatagctctcaccgagcccaagagagccctcctgcagaacacgtttaaaaaaaccaggatgattaatatgaatatcccagggacgtgaaccattaatttcgatatccgctttttccagcagctcatgaacgatgcgataccaatggttttcttcgaggctcacttcttctgcataagatgaactcatagattttccaccacctgtccaatctgaacctgaacaaagagtagccaatttattcaggcaatgagaaacgatgcggatggctccgcaaaccggttatctgtgtgatacagaggactggaacagcctgcagcaggtcgggtaaggtgagaataacgcgcgcgaataccgtcccggcagcagagtgccaatcagattattacgttattatattgttgatttattacagatttgttgacccggatgagtatatgctcacgcgggtcaatattcaataacttattgttagggcgctaactaaaaagtcagtgtgtcactgattatcctggcaggcagtttgcgcagaggcaacaacagtttgtgcgcttgcggcacgctgcatggcgtaacccaacagcgccagcacaattgtcaccgtcatcatcagtgtggtggtaaatagcggctgagttaagccggccgacaccgccaggctggcagcgaaacagagtcctaactgcagtgtgttctgcaacgcagcggctttaccggtagcggtcgggaagggcatcagcgcactggacaccacaatcggatagatcgcgccgttagccagcgccataccgcagaaacggtaccatcagactcaccagcgtgctgctgccagcaagcgcaacagcaaacagcgccagaatgctcaggctgtagacggccagcagccagggcagcaactgtgcgccgttaaagcggttgagcagggtgcgacagccgaagccgccaattaaaaaggcgagcgtctggggcacataactcagaccgatatcggcgggcgacagacccagatccgccagaataaagggcgatccggtcagccaggcaaagaagctggcggagcaggcggagtagatcagcacgttgccgctgtaaacccgggatttaagcagcgtgaaaaagccgggctgcgcacctttttctcccgcggccttgcgcacggtgggcagacgcagcgtggtcagaattaacgccaccgcaatcagcgtcagcaccaggaaaatcgaacgccagtggaagtggccgatcagccaggcacccagcagcggagccagcgccggagagagcgcaaccagcggcataatggtggcaaagactttgttagcgcgcgctgcagggtagcgatccaccaccagcgcctgccagcttacggcagcggcacagacgccaatcgcctggacaaaacgcagcgccagcatcagatagatatcattcacccacagcatgcctgcgcagccagcgccaaacatggccagtccggacagcagcaccggtttacgaccgatgcgatcggaaagcggtccccagaagagctgacccacggcgaagccgcccaggaagagactcatactggcgctgatcagaccgggtgaagtgttaaaggtttgctgcatcgcaccaaaggcgggcaggtacatatcagtggctaaaaagcccagcatgctcagcagggcaaggtagggcataaaccctttattcgacagcatctgattctcatttttgcaggataaacgcggcagagtgtaaaaggtgcgtttgctgctgtgaaacggtaatatttgccgattgctgttaaaatttttgaaggcagattatgtggtcagaatatgcattagaagtggttgacgctgtcgcccgtggggggagcttcagcgccgccgcgcaggagttacatcgggtgccctctgccatcagctatacggtgcgtcagctggaaaactggctggcggtaccgctgtttgaacggcagcatcgcgaagtggttctgaccccggcgggtgagcattttgtccgggaagggcgcagcgtcatcaaaaaaatgcttgccacccggcgacagtgtcagcagctggctaacggctggcgcggccagctaagcatagccgttgaccgtatcgctaaacctcagcgcacccgacaactggtcaaagatttctatcgccactttcccgatatggagctgattatcagctatgaagtctttaacggcgtctgggatgcgctggccgatggccgggtggaagtggcgattggtgccacgcaggcgataccggtgggcggacgttttgcttttcgggatatgggcacacttaactggcgctgcgtggttgcgcccgaccatcctctgacgcaggcgagccagatagatgatgacacgctgcggagctggccatccctggtgctggaagatacttcacgggcactgccgcgtcgtatgacatggacgctggataaccagcgccggctggtggtgccggagtggcaaaccgggctggattgcgtgcaggcgggattgtgtgtggcgatggtgccgggtcatctggccaggccactgctcgacagcggcgagctggttgaactgacgctgccggtggcgtttccggacagcccatgctgcgtcagctgggcagaggatcgcgcatcaccggcgacaggctggttgctcagctatctgggtgatgcgcaaacgcttaatcaggagtggttaagcgagcattaacggcgatagtcgcggaacgggccatcggccacggaaacggcgctcaatcagcgtgggatggacctcaatcgtttgtgacacttcgcgtttactggtaatgcggtccagcagcatttccagcgctttctcacccagctgggctttaggctgatgcactgtggtcagggccggtgcaaaataacgggcgttgcgcacattgtcatagccgatcaccgaaatatcctgggggacgcgtaaacccatctcgtcggcggcgcaaatcgcgcccatcgccatgatgtcaccgccacagaacaccgccgtgggacgctgcttctgcgacaggatctgctgcatcgcctgatagcccgactccggctcaaagtcaccctgcacaatccactcggcgcgtggctgaatacccgcttcttccatcgccttcaggaaaccggcatgacgtccgccaccggtgttacgctccatctggccggggattgcaccaatatcccggtgtccgcgttcaatcagatagcgtcccgccagatagccgccctggaaagcattatccagtaccgtgtcggtgaagtcagcgcgcgactcgccccagtccatcaccaccatcgggatattgcggttctcttccagcatctgcagcagatcgtccggatattcagaacacatcaccagcagcccatcgacgcgtttctgcgccatcatgctgagataggcgcgctgtttttgcagatcgttatgcgcattacccagaatcagcgtatagcctttgtcaaagcagtgattttcaaccgcttcgataatttcagcgaaatagggcgcttcgctggaggtggcaagcaggcccagcgttttggtgtggttcactttcaggctgcgcgccacggcgctcggcgagtagtgcagttctttaatcgcctgccagaccgcgttgcgcgtctcttcagccacaaagcgggttttattgatgacgtgcgaaacggtggtcgttgagacgccagcgcgtttcgccacatctttaattgttgccatgaaaatcggactccagtgcttatctaactctatgataagcgtagtgttaaacgtttgcgtctgctcagggttttttccgcaaaaatgcagcttttaaggccagtcaacaggccgctggcggcgtaaaaacgcctgaaaacgtgcgcaaacggaatcagggttgcgcgcgttgcgcaacaaaggcgggattctaacaaggctgaacggataaaacgagatttttaccgggccctgtgggaaaatgcgatacccctactgattgtgtgactaaggagcaagcaatgagtaccgatcttaaactggctttaatgaccaccgcgggctgtctgctgatgattgtggcctttagttttaccgctattctgcactaaaaaaaagccgggattatcccggctctcttctggttgatctgctgctcagcgtatggtttttggcgtcatcacccgacgggcaccaatatagtgacgctgccagtaatcttctcctaacgcgctgatctgaatatctttgccggtgcgtggcgactggataaactttccatcacccaggtaaacgccgacatggtccgcagtaccgcgtccattgatacggaagaagaccagatcgcctttctccagcgactcacgcttgatcggggcggcgtcacgcaggtggtacatctcgttagcggtacgtgggatcttaaacttcaccagatctttataggcgtaccagaccaggccgctgcaatcgaaaccggtatggggagaggtgccgccccactgatagggtttacccaactgacccatcagcttggtcatcgcggtttcgcgggccttctgatagcgctgacggtgagatttgctcatcttaatcgtgccggtctcgctggtggtgacctcagcggttttcagcaggcgctgatgaccatagcgtttcttctctttgttcttactgagacgggcggtttttagcgaggtcttcttagcaggcgtctgttttgcggtgagttcgacttttttcagtttttttgtttttagtttttgaaccgggctgaggcgagtctttttcgtcaccgttttgaccgggcgacgcttgcgacgctcatcgtcgcgcgcactctttttctctgctttatgcgtactgacgttcaccggtgcgtgaggcgacgcagcggcgatgttgaaaaacagttgcgcaaaggccagcatgaaaaacgtaatgattaaacgcatagtccgttgattagttaagttgtcagggccactacgcaccgcgacaaagttgagattaatctgatccaggatcagcgcccaggccattctagtccagttcttttaaaaactgtaatgccttttaatattaatctttgcaacccacgcaattgtgctgaaaatgaacattttcagcgtcttatatcaacgaaattattacgaattattaatctgttacctgctgttaataatcaggaattcaggtgtcccggagcaggacttaacaatgatggcgatttaatcgggcagcgatcaaaatctcgttttcagtcacgctgcgaagtcgctacaataaacaaacacgatgtgacgaattaaggaaggcaattatgagtactgtagaaaaaattcagcgccagatcgcagaaaacccgatcctgctgtacatgaaaggttccccgaaactgccaagctgcggtttctctgcacaggcggtgcaggcgctgtcagcctgcggtgagcgttttgcttacgtggatattctgcagaaacccggacattcgtgccgagatgccgaaattcgctaactggccaactttcccgcagctgtgggttgatggcgagctggtcggtggatgcgacatcatcgttgaaatgttacaacgtggtgaactgcagacgctgatcaaagagactgcagaaaaatttaaagaagcagaataaaaaaaggccgacatcacgtcggcctttttcattgcggcatcccttatgcggatgtcgtggcttctgcatcgccttccgcgaagggcagtggccagccgcctaaccgtttccagcggttcaccagctcgcagaacagcgttgccgtctgctgagtgtcatagagcgcagaatgcgcctgcgtgctgtcaaactccattcccgccgcaatacaggccttcgccagcaccgtctgacccaataccagtccactcagggccgcggtgtcaaaggtggcaaacgggtgaaacggattgcgcttcaggctggctcgttccgccgccgctgacataaagttcaggtcgaaggtggcattgtgcgccaccataatggcgcgattgcagccgctgtctttaatgcccttgcgcaccattttgaaaatggcgtgcagtgcctcatattcactgaccgcgccgcgcagcggattgctgggatcgatgccagtaaaggccagggcttcgggatgcagcagcgacccgacaaaaggttcgacgttgaaatgcagcgtctggtcaatctgaatccatccctcttcatccattttcagcgtgatagcggcaatctccagtaacgcatcggtttgcgcattgaaacccgcggtttcaacgtcgatcaccaccggatagaagccacggaaacgttgattgagtgcattaggggaattcgattcagacatcaggatctcgttgcagaaaaagggcagcgcgtattatggcaaaaaacggggccgggtgcagcagatgaagcgcagagaaggggattcagcccacccgatcgggcgggctgacaggcaggtttagttgccgaggccgttaccggcatctttgttttcgatcagctcgattttgtaaccatcgggatcttcaacaaaggcaataatggtggagccgcctttaaccgggccagcttcacgcgtcacgttgccgccatctttgcggatacgttcgcaggccgctgctgcgtcatcaacgcccagcgcaatatgaccataggcatcaccgagatcatacttatcgacgccccagttgtaggtcagttcgatcaccgcaccttcgctctcgtcggtgtagcccacaaatgccagggtatatttgtattcggtgttttcgctctgacgcaacacgcgcatgcccagcacacgggtgtagaaatcgattgaacgttgcagatcgccaacgcgcagcatggtatgaagtaaacgcataacatcctcttttaaataaaacgccatcgcccgatgactcaggcgctaagtatagcgatgaaaatcgctattgaataatggctgccgtcatcatcccggacggcagcccgaaccggttacagcgtcgggtagtcgatataaccttccgcgccgccgccgtagaagctttccggacgctgtggattgagtggggcatcctgctgcagacgctcaaccagatccgggttagcaatgtaatcgcgaccaaacgcaaccgcatcgatcagaccgcgaccaatcaggtcatccgctttctcaacggtataagcaccggcaccaatgatggcacccgggaagagatcacgcactttctgacggaaggcgtcggtgtaaggctgaccgccggcccagtctggctcggaaaggtgcagataggcgatgttgcgttttgccagctcgccgatataccacagcgccgcttcctcttcatccgggccgttgtccagattctggaagctgccgataggtgagacgcgaataccaatgcgatcggctgaccagttagcgatcaccgcatcaaccacttccagcgcaaagcggccgcgtttttcgatgctgccgccatattcatcattacgctggtttgagccaggagccaggaaactggtgcatcaggtaaccgtgcgccgagtgcagctcaagcaggtcaaagtccgcttcacgcgcgttggccgcagcctggccaaaatctgccacgatctgcttaatctctggcactgtcagctcacgcggcgttgaggtatcttcgcgatagacgctgccatcttcagcacgcagtgaggtacgggtgccagcggcaatcgccgatggcgcaaccggtgctttgccttccggctgcacgctgttatgtgagatacgaccggtgtgccataactgtactgcggtgtgaccgccagcctgatgcacgccttcgttaatcgctttccacgctgcaatctgtggctgagtatgtaagcctggcgcaccggcatagcctttcgcctggaaagagatctgggtcgcttcggtgatgatcaaaccggcgctggcgcgctggcgataatattcagccatcatcggggtagggatgtcgcctggctcaatgctgcgcagacgggtcagcggtgccataaatacgcggtttgggacggtaattgcaccgacttttagcggacgaaacagctgggtactcgccataatagctcctgattagtagaccagtcgtctacaaacatgttttttaaaaatcagcggcgttcaagccactgttcgatggtactcaatgccagacgcagtggctgcgcctcgcgggaaattttgctctgcaggctggcacccagccacagcagcgacagcaattccgccatctgcgcggggggctgcggcaggctcagcgactcctgctgctctgcggcaatcagggtccgggcgtagagtgccgtgatctttccggcaccctgctgcaatgcatcacgcatcggctctgagagatcgcacacctccgcggagactttgacgcccagacagcctacgatgtggccctgctgaacaaacagatcaacggcagcacgaaagtggttaagcagacgctcacgcggcgtgccttcggtctggttaagctgcaacgccacatcctgcaggaaacgcgcaaaatagcgttccagtaacgccacgccaaacgcctctttagaacggaagtagtagtagaaggagcctttcggcaccgccgcctgcgtcagcagtttcgctgaggcccattccggtaaagccgcgttgcagacagagttgctcacctgtctggagcaggtgttcgcgggtttcgttgcgttgtagcgtcttattcatggcagtgagattagtagaccagtcggtctaatgcaacgcaaccctctctatttggcacagagtgttcactcctgagtcaaagaacaggataattctggccgggtggggcttacttcctgcgcaaccaggctacgctttttactggactgtttattctgtgaatccggaggcgtggtggccgagcagcttgagtttttcccggttcccagcccctgtcgcggcatctgccagacggatgcgcgcggctactgcctgggatgtttacgcagccgcgatgagcggttcaactggctgcgctttagcgatgcgcaaaagcgtgaggtcattcgtctctgtcagcagcggcgtcagcgtctgcaacggcaacagaaaggcgaggagccgcacgcgccacaacagccggagttattctgacgactttgcgctttccgttatactctctgacacgctaatttcagccaacgcgcaacagggagaacgtcatgttagaaccgcaagccatcgcttcacaggggcccgatttttcaccgctggtcatggggtactggcgtctgatggagtgggggatgtcgccacaggaacgggtcgcctttattgagcaccatgtgaggctcggcatcaccaccgttgaccatgcggatatctacggtgactaccagtgtgaggcggcgtttggcgaggcactgaaactggcacccggcttgcgcgaccagctacagattgtcaccaagtgcggcatcgccacccgcgcccagcctgagcatcagataggccactacattaccgacaaacgtcatatcctgcagagtgctgaaaactcactgcgccatatccacaccgatcgtctcgacctgctgctgatccatcgtcccgatccgctgatggaggctgacgaggtggccgaagcctttatggcgctgcatcacagcggcaaggttctgcattttggcgtctctaacttcacaccatcacagttttccctgctgcaatcccgtctgccgtttctcgctggtgacaaatcagctggagatctcacccgtgcagcaaagtgtgctgctggatggctcgctggatcagtgtcagcagctgcgtattcgtccgatggcctggtcctgtctgggtggcggtcgcctgtttaacgatccccatttccagccgctgcgtgacgaactggaagccgtgcggcaggaaaccggtgccaccagccttgagcaggtggtctatgcctggatactgatgctgccatcgcgcccgctgccaatcatcggctcaggtaaaacggcgcgggtcagcgaagccgccggagcactgaacttatccctgtcgcgtcagcagtggttccgtattcgcaaggcggcgctgggatttgatgtgccctgaagcgtaaaactgcgtcaatctccggcaaaatagtgcaacagcgaccagacttatctcaaaccctggtatgcaaatggagtcaccatgaaaatgaaagcagttgccttattcgcactgatcgcctgcggctcagcactggctgccagcgagcaggttacgatccatcaggttaccgctgaagggattgggaaatcgctgggcaccgttaagattgacgagacacagtatggtctgcagttcacgccggatctgcagggccttcagccgggcattcatggtttccatgttcatgctaaaggcagctgtgaaccgggcgagtctgaaggcaaagtggtcgccgccggtgcggcgggtggtcaccttgatccggccaacagcggcaaacatctggggccttatgcagaggggcacctgggcgacctgcccgcggtctatgtcgatgacaaaggcagcgccacttatccggtgctggcgccgcgtctgaaatcgttaaaagagatcaaaggcaaagcgctgatggtgcacgtcggcggtgacaatcatgctgaccatcctaaaccgctgggcggtggcggggcacgctacgcctgcggtgtaatctgagtttccgggcggcaggcgatggccgcccgcttttctcctgcctgtttatgaattgttgtaccatccctgacatttcccccctatgatattgattcaggtaagaaagcgtgatggggaaaggagcaggaaaatgaaattcaagggcgcattactgctgtgtctgctgctggtgggatgcgataaacccaatgatacgcaactggtcaccgaaaccggacgcgaactgcagcgcaccatcgataccaacccaatgcgtatcacctgtgaaaagatcgcgaagggtcgtgaatggctgagccgcaacatggtgcgtaagctggaagcgcagggttgcgatcaggtctttcgcagcgccaccgaaaccaatttcacggatagcactatttatcgccgtaccatgacgatggtgtgcggtggcattcatggtcagagttttaccggtaccgaaactgacacgccggtttatcttctcacccgatgagaaagtgctggtgattgaaccgatgaccgaaatggataaaacccgcttcgaaggccataaaacgctgcaacagctgcaggatgattttaaccggcaacagcagcaatattgccagtgatcactccggcaccgcctgcttcagctgtgccagtgaacagcgtaaccgccagataatccccgccagctcgctggcctcgttgctttccagtgccagtaacgcggtgatggtctcctccagttgcgtcagcattcgatccagcgagctgtggcgcacgccgcggctgctgataatctgctgtaagtcttgcaggcagtgatcgcgaaaccccatcagtgcggctgaaccggcgcgccattcacgcagctgccagacgatatgcgagcagttgagcagcaccacgccccagcgcagtagccagacgcgtgcctgctcgtcccggctgtgactgagctggctgatgcggtggtaaatctgcgattcgaagcggctctcgctgagccggggccgctgccgcagctgatcgagaaacgccagccgcagcgcccggatatgccgtcggctgcgccgcgcatcggagctgggtcgcagaatctggaacgccagccaggcgagcagcaccccgcagactttggcgatgttatcgttaaagaagtcctgataatcccatgtgggcggattagtcaccgcgataaacgagcccataaagacgatgaactgtccccacatcccggcgcgctgtttctgctgcagcttaaagagttgcagcgtcaccagcagcgggaacagaaacagcaaaaactgccacagctgactgatctgcaccatcagcccaaacttcatcacaaaactaaacgcaaacagccacagcagggtcttcagcagcagcgtgacgctgccgccaggtgaaggtgatgaagcgtagagcacacaggctatggcggttaaggtgagcgcggcggcacctgaagaccattgcgtattgatccagaaggcgcagcccagcacgataacgcagaaggtacgcagggcgctccagcccgcctcggcgctgtcactgtcgcgcgccagcgccggaaccggcggtggctgaaagcgggtgtcggcatcggcgcgatccagcaggcggatccagcgcagcacgttgaggtacatccagcagaagtagcgcagccgctgacaaaaagcgcgctgccggtagtcgccatccgctgccggggtcacgctgcgcaggatttgcgccagacgatatttatcacacgccggtttcgccagctccgccagcagttgttgcagcgcgtcaaacagcgcctctggcgcgtcgggccagttcagcagcatgcgtcgcaggctggagagcacgctggtgagtcgcagctgctggtgcagcacatagttcagcacgttgttctgtcggcgaaagcggtagtggctccagaaacgcctgaatccgcagcagattcatggtcaggatctggctgatgacattttcatgcgcggtccggatggtctcgctggctgagggctgcagcagtaataccgcatgttccagcagcctggcatgcatctgtttcagtgaggtaatcagcgtctcaccatcggaggtactcggcagtaccatcatcattaatccggcgcagagaatgccggagatcacctcgcaaacccgtgcctgagcgatggtccatagcgaggtgatatcggtgatgttaacgctgctaaaggcgatgatggcggcggtgtagcccgccagcgaaaaggcgtaggcaacattattctggtagtggttcgctatgccggtacagagcgccagccagccggcaatggcaaaggtaaacagccacggctcattaagcgtatgtccggcgatcagcagcgcagcgctggcccccatcagactgccaacgatgcgccccagacttttactgatcgcgccgccgacggtgggaaagctaatcacggcagcagaggtcattgcccagtacggctcatccagatccagtgcgtaggcgatgctcagcgccaggcacatcgcaatagcgttgcgcaacgcatagcgccactggccggcgttcgccttaatccagggcagttgatcccaggccagccactgaaaattcatggctggatggtgatggtgcagctggttcccgccaccagctctgcatcggcaggaagcgggtcgagacgaatacgcaccggcacccgctgcgccagccgcacccagggcacgttgggtttgatatcgggcaccaggccgctgtcggtctcaatgctctggtcatagatggcgcggccaatgctatccacctgaccctgcagccgcataccattgctgtagagcaccacctgggccgctgcgcctgggtgaatatggcgcagtttggtctcttcgaagtagcccattacgtagtaagagtggctgtcgaccagagcaaacagaggcgaacccgcggtggcatagttgccgggacgcagcgtcagattggtgatccagccatccgccggtgcggtcagcgtcgtctgctgcagattccagcgcgctcgttcccactccgcctgtgccgctttggtgctggcggccgccgcgccggcgcttaatcgcgcggcatcaaggtcctctgcggagatgatgttgcgcggcaggctgctgcgacgattaaattcatgctgcgctttcgcgagatccgcctgcgctttgctgagctgggcggcggcattgtcgagcgcgatctgccatggcaccgggtccagcgttaacagctgctggccctgatgcacaaactgattgtctttgaccttcagttgcgtaattcgtcccgacacctgaggcgtgatatccaccagctctgcccgtactttcccgtcacgggtccagggcgactgcatgtagtagttccagagccagccagcggccagcagcgccagggcaaacacgatcagcgtggagaagtattttaccgcgttaaatttcatatcgattatccgtgaccgatgagccagagtgcggcggtaacgcacagcacaaacagggagagatcaaacagggtgggatgccagacatcgccggagtagatccagccacgtaccagagggtggatcagcagccagaaaaagaagccgaggatcaccgctttgaatatcggcgggaaaaacagtgaggcacccaccaccagatcggtcagcggattcgcacctgaaaaagcaggagtgagcacgtgataacatccttcgttaacccaaacagcagagtgaaagcgctgccacgttatcgtggcctggtccgggatttgtaatttgtcctgtaaactcgcagaatagtgtaaaatctggcttgatagctagcaagctaattataaggagatgaaatggatacgcccctcggaacggatttatctcgcctggtgcgcatctggcgcgcgttgattgatcagcggctgaagccgcttgagctgactcagactcactgggtgacgttgcacaatattcatcaactgccgcccgaacagtcccagattcagttagccaaggcgattggtattgaacagccttcgctggtgcgcacgctggatcagctggaagagaaaggattaataacccgttcgacctgcgccaacgatcgtcgtgccaagcgcattaagctgacgcagcaggccgagccgataatcgaacaggttgagagtgtgattgatgagacgcgggatgacattttgtccggcatcagtcgggaagagatcagtcagatggtgacgctgatcgcccggcttgaaaaaaacattctcgaacttcagcataaagagaaataaaaaaaccgacgcccaggcgtcggttttttgtttagcttcattagcgaggtgaaaccgtcacctggctgccgttggatgccatcacaacacgctggccaacagagtaacgcgtggcggcctgtttctgaaccaccatgatggtgttgccatcatccttacggatttccagctcaacgccatcggttttattgactgcgccctgtacgccctggcctgctacgccacccagaaaaccgcaccaccggctgtcgccaggctacgtccgctgccgccgccaatggtgttacccaggaagccacccagcaccgcaccaccgatagcaccgatgacattgctctcatcgccgccctggattttcaccggacgtactgagactaaggtaccgtacgaaacgctctgcacctgcttagcttcactggcactgtaggtatcacccgacagcgtactggtattgctacaacctgccagcatcacaccggccagagcgaccacaattacacgcttaatcatttgaaactcctttagtcgagaaggtgccacgtttaacgctgtatcctgctcacagtataagacacaaacctggcaaattaatccctgtccgaataaaacacggctggacgaagcatagactatgcaggatcaacaataattcaatcgtggactaaaaatagtcccattacgttatcagtcagcacgattggataaaaagaatttaatcatagaattagcgatcattatttgtcaggctaaccgcagatgaatcgcacctcccgccggaagtaaggaatggctatgaaatcaggacgctatattggggtaatgtcaggcaccagcctggatggagtggatgtggtactggctgccattgatgaaaatatggtggcgcagcaggccagctactgccatccgatgccaccagaactgcgtcaggcgattctggcgatatgtcagggacagtccctgacgctgtcgcagctcggccagctcgatacccgcctcggccagctgtttgctgaagcggtagtgacattaatgaaacgcgaatcgcttgacgccagcgatatcacggcgattggctgtcatggtcagaccgtctggcatgagccgcagagtgacgcacccaatacgctgcagattggcgatcataatcagatcgtggcggccaccggcgtcaccgtggtaggagatttccgccgccgtgatatggcgctgggcgggcagggcgcgccgctggtgcctgcctttcatcaggcgctgctgatggatgcttctgaacgccgcatggtgctgaatattggcggcatcgccaatctctcgctgctgatcccaggtcagccggtgcgcggcttcgataccggtcccggcaatatgctgctggacgcctggatctggcgtaatcaggctcagccgtatgacaaagatgcgcagtgggcgcgcagcgggtcggtgattccggcactgctggaggcgctgctacgtgagccctggtttgcgttgccgccgccgaaaagcaccgggcgcgaacacttcaacctcagctggctggagcagcatctgcgctatttcccgggtctggctgcgcaggacgtgcaggctacgctggtcgagctgaccgccatcaccatcacgcagcaggtgttactcaatgatggctgcgaccgtctgctggtgtgtggcggcggcagccgcaatccgctgctgatggcacgactggcagcgcatcttccgggaacggaagtaacgactaccgatgcggcgggtgtcagtggtgacgatatggaggcgctggcgtttgcctggctggctttccgcacgctctccggcctgccgggcaatctgcctgcggtaacgggcgcacgggaaaaaagcgtgattggcgcaatctttccggcgaattcactctaccgacgctaagcggggagtcgggggcaatctgcccccgcaggatgacaggtggccgtcaggcggcgccggagagatgcgtcaggttgcgaacgccagtaatcaccgaggcaaccatggtttcacgtcgggtaatcacctcaacctgataaaaccggctgcggtaggcgatggaatagataacgggatggtacttattaccttctccgtagcgggagtagtgcgcttcaagcgcacgggtcgctgcgagaatatgggagggttctttatcaccgcggatgatttgcttcattcagttcctcaaatgctgtccctggagacacgtcgcacgcatggcgcgtagcgctggcctaaacactgaacatctgactgctaaacatttaatcactgactgggtaatgactgactctgccgcgggaagatgacagaaagatgatcccccggggctgttaactatttagcagccaccgggggatccagcaaggcaggaaatcgcaaattcatccaaatcgcagaggcggtcagatcagctccggccaggctacggccgcaacgccattgagtacaggttttgagaacagaaagccctgaaactgggtcacgcctgccgcttcaagccacatccactcttccggctgttcaatgccctcggcgataacaccgatctccagcgaggagcagcatttcagaatggcatgaatgatcgcctgcttcggcccacttttatgcacatcagcgatgatggttcggtcgattttaatcttgtcaggctgaatgcgcgtcagcagcgacaggccggcaaaaccggcaccgaaatcatccagcgccaggctgatgccggccgccttcagctgcctgatggcggcttcaaaggcctcaggctgcgagataatttcattctcggtgaattcaaccatgatctgctctggcaccagtccctgcgcagctatctcatccagcaaaaacgggacggcgtcgggcacttccaccagcgtcatcggcagcaggttgatcgacagggtcatgccctcaatccccagctgcttcgcctgggcgaaggcgatctttttcgacctcagatcgagctgatagagctgctcacgtgacagtcgggcaaaatagtcgagcggcggttcaccctgcgggccgcgcagcagcgcttccagcgagacgatttcgcaggcgaaggggtcaacgatcggctgaaaagcaaagctgacctcatccgcagccaccagcgatgcgttgccttcacgctgttctgactcgtcacagataaacgtccagccgctggcggccgggatctcaaaatagttctctttttcccgcgcttcgacaaaggtgcgcaggaactgcagtgcgcgatcggcataggtcagctgatactttgtggtgcactttgccagcaccgcctccagtaccgtctctttatcatgcagccgcagatcgaacagctccataccgacgtggccaaaacggcgtgccggggcgtaatcgcgcagcagttcgaccagattatggtggcgtggatcctggcaaatccggctgtaaactgcattgaccgccgcctccggaccttccagcagctggaaaaaatgcgtgccattgaataataaaattccggtgacgcttgaggatttattgattttattcgctttcagcgccaaaccattcaggatctcaagcggcacatgttcggtaatgtggctgcgatagatgattgtcgacaacataaaggtttccggaattttttattttttgttatggcaccctaccagaagcttcttccggggaaaacgagggccagtacgtctttctcactctgactctgttttaatcaaccggcagcgtggtattgcccgtttcccagagagcgctgcataaaaacggtatccagccagcgaccctgtttaaaacccaccgagcgcaggatgcctgtcatctcaaagcctgcggcgcgatgtacggcaatcgagccctgattctcgctgtcgccgacgttggcgatcaactggcggaaccctgcctgctcagcccagcggattgcatggtttaacaggcgcgaaccggctccgcgcttctgaaatccaggatcgatgtaaattgagtcttccagcgtatgccggtaggcatggcgcggacgataaggcgtcagataacagaacccacgcacttctccctcgctgacggcgataaaccacggcaggcccgcctgctgaatcttccgcatccgctcgtcaatctctgccgcgtcgggcggcactgtctcaaatgagccggtgccgttaaggacatgccaggcgtagatctgctgaatcgccatgatgtggcgttcatctgcctcaaaaatttccattatgcggttttgccccgaaagtctgcacctggtggaaaaacaacggtatagcgggcgatgtgagggcgcaatataaatattacgcgctcatgaaattttatgagtgcgtcgttctccaggattattcctggcaggaagcagataaaaaatcacgtcggtttagtgccactactgaatggtaattaagcctattctgaaaacagcgtcagccggatgatccgggccggcgttaaggctattatcttcgcgattctgatggggttgatttattaactggaggcgcagcgtgatgcgatttgttgattttctgaatagtaagcaggggctgcgtgcagcaagaaatcactgctttgaattaaatggtgtggtactgggccattttactgcgttattcctgcatgataaccagattatttttaccaaagatggtaagcagtgtgctgtgccttattatctgggtcccgaagaagatttgcttcaacagaaaataaatccgcgcattaaaaatattcgcgcgatctgaacggacgccgcgatgagtttatcgcttcagccataacacctgcgtaatagttcctcattccccgggcgataatattggcactgtctggtaaatagcatcgacgctatttctaactcccctgttttctgccaacccattcgtttacgcctgcttatttacccgactcgctgctgttctgcgcgggtgcaataaacagcagcagcagggcgctgaccgcaaacagcgttaatgccgtactggctcccaaagaggcgtagagctgaccaaacagcagcgatcccgctacctggcccaccgccagcataaagaacaggatgccgacgccggtcgccggatcttcagcagtggcgcgtgcgccccacaccagcagcacgcccgatagcgtgacgtaacctgcgccacagcaggcaaccgcgatcgctaagccggtggattcgccccgactccaggccagcaccagcagtggcactgccatcccgcacagtgagagccggtatacacccttcagcccgatacgggcagcgaccgggccggttgccgcacccacgatgcctgctcctccggcaatcagccagagtaagcgggcggtctcctcatcaacaccgacatgctgtcgcagcagcgctgacccaaagctccaccaggcagcactgaccagacccgaaatcaacgcaatactcatcagacgatgcatggagcggcgatacagccgctggtgccagtgacgcactctggtggggcgactggcggcgtgacctgataacacgcgcatcaccggcagcacacaggccagcgacagcaaagcgaacagcagacaggcggcacgccagccgccgggcagaaacgctcaggatgaccaccgtcaggataatgcccgcgctggtgccggcattgatcagggtattgatgcgcggctgacccgcagcagggattcgatcgctgaccgccgccgccagggcaggtgaagccagaccggcactcaatccggcaataaagagtccggccgccagcagcagcgttgatgaggcacaggcgagcagcagcagacccgccgtcgcactgagtgaggccagcagcgccgtcagccgggtgccatagcgatctgccagcgcggctgcggtaagaatagtgaggcaatatgccacaaagctgcaggctgacagcatacccgcctgctgcgggctgaaggggatctccgctgagatagcgggcagcatcaatccccatgagaagcgcgccatgccataggtcacggcgatcaggctgaagccggtcagcgccagcgcgatgggcgatctcatcctgtcgccctgttctgaagtaactgactgacgacctgcgccgcctgttgagcagcggcgggaccggtaatcagcgccgtggtaatggcaccctcaaagagtatccagatagcatcactcagcgacttattttcagcaccgcgcagatgcgtcacacaaagggtgatataagcccgcatcgtggcccggaaggctagcgcctgagcggccagttcactgtcccgctcggcatactctccccaggctttaagaaagaagcagccacgggcaccgttcgcctctgtccactcgcccagcaccctgaacagatgcgctatcgcatcaggctgttgcggtggcagcagatcggccataaagcgctgctcgcgcgcgacgagtaccgctgcggtcagcgcttcgcgtgaggcgaagtgatgatagagcgtgcgggtagagacgcccgcttcgcgacagatattgtcggtgctggtggcgtggaaaccgtgggtgtagaagagccgctcggcggcctggatgatatcgtttctctttttcatgctttaaaagtaaaccgatcgttttactttttcaagccggtcgctgttaattacgcccgctggtattgataagtccctgatgccaggggagctggcgttccgcttaaaggcacgctgtgcaccactttcactcttattcaggttcagtttatcaatactcataaatacccctgcggggatgatatttttcagcttctgctctaatcatatctgagtagcgcgtcacccctggcgcgcgggttgattttataatctgttgttttttaggttttattttgttttttgcttttttaatgatgcattagcagtataaatgtaagcggggcgacagagagggtgagggcgttacagcgcgtggaatgcctgaagcgacataagcaatgaaaaagggcatattctcaaagtcagccagactcacgcaataaagtggttttagggataattctcagttagtttaataaagcttcagattacaaaaaaaacctcttacgaattttggttcgttttttaagatacatacagcaactatcaggatgactaccatgctcaaagccagctactattatctgtgcccgcgtcccatgggtggatggattttacacaaagaaggttgcgttaatctgtcaaagaacgataaacgcgtttttattggttcgctttatacccgccagcaggcgctggccgtggcgaaagtccatcacgctaatgccatactctgtaatgcctgcctgagcacttttatttgcccgaccagcagcacggcaattaaaccggcacgcgcggcaacgccaacccgccatacgccaaaacattaatttgtatgcaggcagttattgttctgctgtggcagaaggataataaagggaattaatgctgcgggccggttagaataaaaaaaggcagcgtaaagacgctgccctgttctttatttaagcctgtttaggctggccatttgaagcggtaattccgccatcaaccggcagattaacgccggtaatataactggcttcatcgctggcaataaagagaatggcacgggcgatatcatccgcttcaccggcccggcgcagtggaatacggtcgtaaaagcgctccagcagcgcctgatcctgtttggcatcttcggtcagatcggtaaaggtaaagccgggacagattgcattgactcgtacgccatctgcgccgtagtccatcgccagcgcacgggtgaagttggtaatcgcccctttagccgcgttgtagatgctcatgccccagtcgccgcctaaaccggaaacggaagagatgttaaccacgttgcctttgctctttaacagggcaggcatgaaatagtgtacgccgtggaaaaccccatcaaggtcagttttcatcagggttttccatgcgtcgagatcgacctcatggatgcggccctgcacgatgacgccggcattatttaccagcacgtcaacacggccatacttcttcagcacggtttctgacagctgtttaacctgtgcggcttctgagacgtcgcaggcagccaccaggtgatcgcctggcgtcatgtcggccagcgtctcttccagtttctgcgcggtacggcccaccagcaccactgatgcaccctcttcagcgaagcgttttgcgctggcttcgccaatgccggatccggcacctgtcacaaccacaactttctgcgtaaatctggacattatgcctccttttcagcatcaattctcactgttaacaaccggttaagcctggcagcgatcgccagaaacacaagcgcagcgcgaaatgcgctgcgccagatgactgctttttaaccgggtcagcggctatggacgtctgaacagggcgaagctgcgtccttccagttcgaaatccttctccttggtgatcaccagaccgcgcttcgcggtgtcgctggtggtcagttccagcacccagccgccttcaccaaactgcgggatctggaacggtacattgccttcaaacggattgaacagcatcaggacgtcgtgccagatgccttcctcggtctggaggtccggtcggccgatataaacccccagcgttgagccttcatcccactgctcagcctgctggaagccgccaccggcgttaaaccatttgatatccatgccatcacgccagttttcacggcgcagtaacggctgctgagcacgtaacgtcaggatctggcgggtgaactcgcgcagcgcctcggcagattccggcaggttatcccagtgtacccaggagatttcgctgtcctggcagtagccattgttgttgcccatctggctgcggccaaactcgtcgcccgccagcagcattggcgtaccgtgtgagaagatcagcgtggcgaggaagttgcgcttctgacgctcacgcaccgcgttgatgctttcatcatcggtcgggccttcaaccccgtagttgtaagagcggttgtcgttgtggccgtcgttgttgtcttcgccattctccgcgttatgtttgtcgttgtacgacaccagatcgttgagggtgaagccatcgtgcgcggtgataaagttgacgctggcccatggacgacgaccgtgctgatcgtagagatcgccggaacccagcaggcgggcggcaaagtctgtggagacgttgttgcctttccagtagtcacgcaccgtatcgcgatactgatcgttccattctgcccagcctggcgggaagctgcccacctgatagccgcccggaccgatatcccagggttcaccaatcagctttttctgcgacaggaccgggtcctgcatgatggcatcgaagaagccgccgcgcgggtcaaaaccatcaggctcgcgaccgagaatggtacccagatcgaaacggaagccgtcgatatgcattgattctgaccagtaacgcagcgaatcgagcaccatctgcagcacacgcggatgcgaggtgttgacggtgttaccggtaccggtgtcgttgatgtaatagcgatgctggtctggcaacgtacggtaataggagaagttatcgatgcctttaaacgacagcgttggccccagctcattcccctcggcggtgtggttgtaaaccacgtcgaggatcacctcaataccggcatcatggaaggctcgcaccatgtcacggaagccctgaatgccgcgcggcccaaagtagcgggtggcgggggcaaagaagttcagcgtgttatatccccagaagtttttcagccctttatccagcaggtgctggtcatccgggaaccagtgtaccggcagcagtttcgaccgaggtaatgcccaggcttttgatgtagtcgacggtcgatttgtggctcatgccgtcaaaggtgccgcgcatttcaggtggcagggcggtgttgagctgcgtgaagcccttaacgtgggtttcatagatgacggttttcggccacggcacattcgggcggtttttatcctgccagtcgaattcgttgggatcgatcacccggcactttggcgtaaacggcgcgctgtcgcggctgtcgaaggtcagatctttatcgtcatgatagagatcgtaagcgaagtgcgcttcgttccacgcgatgtctcccgccagttcacgggcgtagggatcgagcagcagcttgttcgggttaaagcgatgaccattttccgggtcataagggccataaacgcgatagccatagagcgcgccgggctgcaggcccggaatatagccgtgccatacttcatgggtatattccggcagctccagacgggcaatttccgttttaccgctgggatcgtacagacagagttcaacccgctcggcgtgggcgctgaacagggcgaagttcacgccctgaccatcaaagttggcccccagtaaatggctgtatcccgccgtaatttcaaaacgctgactgtttgacatttatgcctcgttattcaatgaacagattgacgcgtaataaaaaaagttctttccggaattcactgtgccaccagcacggcacaccactgcgatgccagcccggtaagcggcaactggtcgcccgcagccaccgttttaccggtcagcacatcctggtagcggcgctggcccagtgcggtgggcagcgcaatgaccgtgtcagcccagcgcgcagcgggcggctggtcgagattcgccggcaactggttaaagacccggcgtgacacaaccactatcaccgcctgatcctgtccggtgcgggcaaaggccagcacattattctgctgctcgccctctgccgacagtgccagatagtcaccgtggcggaacagggcaggctgctgctgacgcagcgtcagcagcttcacaatcgcctgctgattgacctgaccgcgcagccagtgcgcctcactgccgtcgtgctgtgacgcgttaagcatcgccgccagcgcgtcgaaatcgggttcgcggcggttatccggatcgaccaggctgaagtccagggcctcgctgccctgataaatatcgggtacgccaggcgccgtaagcttcaccacagtctgggtcagactgttgaccagaccggcacgcataaagggttgcagcgactggcagaagtcactgaggaaggtgctgctggcgggcgcaagcaggtgacgggcatagcccagcactgcctcctcataggcgtcgttattgtcggcccagtcggtacgcagcttggcttcacgcagcgctttttccacatagaccacaaagcgggcttccagcgccgccagaccttccgcatcctgcggctgcagggtggttggccagacgcccgccagcgcttcatacagcatccactccacggccggttcgggtgccggaccatctttcaggcgtacgacctgatcgtggttcatctcccgccagcggttgacgcaatccgcccagcgttgcggcgcttcggtaagggtatagagtcgcgcacgcgcatcttcaccgcgcttggtgtcgtgcgtagaggtgcccgacagcgcatcgggctgatgttcgcgccgcgcctgcatttcagcgtgaaactgatccagcgagaagtggcgcgccagcggttcagcgccgacttcattcagcgccagcgccatgtgctgacggaagaagagggtatcttccaccgatttcgccatcagcggtccggtcagctgctggaagcgggtgcggaattgcgtggcatcgtcgcgagcggagtcggcaacctctgcgcgcagaatatgggtcaggaaatcaagcgcctgactgtcgggcgcatgggcactggctttgacctcgctgaccacctgttgcaacagcgcggtgtcggctggggtcaggccctgcggcgtaccgtaggtgcgatagaccgggaacgccaccagcagttcacgcagcgcattcttcagttccgcttccggctgtggcgtgccttctgcgtcggcaatcttcagtgccagctgcagtaatcggttaaattcaccggcaaaattgcggtttgccatcagcagtttggcggcgcgcagctccgctttcatatcaacggttttaccgatgacggcctgatacgctttgcgcagtccgctcagctgatcgctgtcgaccagcagattggcgagtgcggccataaattcatatccggtggtgccggaaaccggccatgcatcaggcagctgttcattgtcacccaggattttctccacagtgagatagcagtcgggaccggccgcctggcgtaactgttccagatagccgtgcggatcggccaggccatccacgtggtcgacgcgtaagccctgcaccgcaccgctgtgaaccagttccaggatcagctgatgcgcggcatcgaagaccgttttgtcttccacgcgcacgcctaccagaccggtgacttcaaagaagcgacggtaggagagatcgttgggcgcatcgcgccacgacatcagccgccacggctgctggtcatgcagttcagcaatctccgccgcgtcgcgcagggcgagtaccgcttcttcccgatcctgccaggtatcaggtgccagcggatagaaattgtcgaagtaggccagcgccggtttgccggtctgcggatcgcgcttcacgctgatctcgccgttggccagcaccgcctcaaaggtgtcaccgaggaacggcagcgtcaggcggcgtgaccagtcgatatcgaagtaatgcgcatagcggctctgttcgccatgctcaatgacgtcgcgccaccacgggttctccagcgaggcggccatgtggttgggcacgatgtcgaggatcagccccagcccggccgctttcagcgcggcagccatgcgatcgaatccttcacggccgccaatcgacggctcgatctggttaacgtcggtcacgtcatagccgtgggtcgattcagcagtagcgctgaagatcggtgacgcgtaaagatggctgatacccagctgtttcaggtagggcaccagcgccgccgcacggtcaaacgtcatgccgttgcggaactggatgcggtacgttgcggttggaatattcattctgcttctctcttagccagacgtaccacgatagcgttgggaatcagttcgctggcggcctgcggccaggcaaacagcgtttcgcctggcagatcggggatcggctgtgtgctgttgccgacgttcagcgccagtgacagcgtgccctgcgggaagtcccagcgcaccgcgaggaaaccttccgccgttttcaccacctgaccggcatcgccaccggcggtctgcaacagcggcacgatatgttgctgacgcagggccagcagctgacgcgtcagcgccagccactgctgaccttccggcgtttctgttcgctgccagttaagcttcgactgttcaaaggtggtgacatcgttgggatccggcacagtttcgccgtgaccggcatggccttcaaactctctggcgcgaccttcacgcaccgctttggccagatcgccgtggaaatcggtgaagaacaggaacggccgggtttcgccatactcttcacccataaacagcagcggaatatgaggcgagaccagtaacatcgccagcagcacctgggtgcgctctgcgccggccaggctgatgagcctttcgccctgcgcacggttgcccgtctggtcatggttctggatgaagtcgacaaaggcgaccggcggctggctgctgcttttcacgccgcgtggctcgcccgactgcggcgagacttcgccctgatagacaaagccttctgccagcgcccgcgctacccgctgttccggctggtcggcgaaatcctggtaataggcgtggctttcaccggttgccagcacatgcacggcgttgtggaagtcatcgttccattcgccggtaaacagcggagcgtccccgttttcgtcacgcggatgcaggaaggtgacgttacggcaatcttcggtggtcagatgaatagggcgatcggtaatcgaggcgcggatgcgctcagcaatgtcaatcagcacatgcttttcgctgggatcgtcaatctgatcgatggcgtcaaagcgcaggccatccagattaaactcctgcagccagtagagcggcgcttccacgatatagcggcgcaccgcatcaacgtcataggcgataccggcgccccacggcgtctggcgcgctttgtggaagaagtctggtgagagcagcggcagatagttgccctccgggccgaagtggttcagcacgatatccagcactaccgacagaccgtggccgtgtgctgcgtcaataaaggctttaaaatcatcgggtgtgccgtaggcggcatgcggtgcatagagcagcacgccatcgtagccccagccgcgattaccaccgaactgcgacaccggcagcacttcaatcatggtgatgccggtttcagccagcgttggcagcttctcaatcgccgcccggaaggtgccctcaggcgtaaaagtgccgatgtgcagttcatacaccaccgactcctgccatggacgacccttccagctcgtgttctgccactgataagcgtcaggatcgatcaccagcgacgggccattgacctctgctttctgagcgcgggcggcgggatcgggcaccgctgtaccatcggccagcacataatcatattcggcattggctgccacaccagcgacctgagtttcaaaccagccgtcagcctgcggcatcatctcaatgtctttaccggagagccgcagcgtcacgcgttgctgaccggttgcccagaggcggaaacgcacctcgtcgctggcaacccgttcagcgccccaacttttaaaaaaagatttggattccattcagttgcctcatttagcctggaaatgcgcgatggtggccaccgcacgaaaaggatgtcgatgacgcaagcgtcaaaaaatcttaaagctatcagcgagaccaggaggccaggtgggctggcgcgtctcttcagtcagaaagccggactggtattcagcgtggtgtggcggaaaacgggccgtgagaccgcttccacgcggcatacagagagtaatcatagactaagatgttgcaatcgcagggcggcgggaggtggagaggcattaatttgcgttaattgctgtgaatctgcatccggcggggcgaaagcaggaaccaggcgcagaaaagcctgccggatggcgccgattcgctataagctaatgcgcgatggcgcaggtcgctccggatgacctgcggcgctgaacacttcagaaggatgttacgtgaggaaaagagttctgttagccgcgttgttgttgctggtctccgcctgttctaaccgggtcggacacaggctggacagcagtaatctgcagcaaattcatgccggtcagaccaccaaggcccagctgatcgcactgtttggtcagcctgacagtgaaacgccttacccggacgggcagcggttgctgaagtggacctacagcgaggcgcgcaccctgaataccaccgaagggcagacgctgactgtgcagatgaaaaatgacaaagtgctgaactatgcgctgagtaaaagttaatgcgctgagcaaacgtgaatcacggcggcggcagatcgccaccgcgcattctggttactgcccgccgctctgctgtgcgtcccggctgtcggggcgcggctgagccagacgggcaaaatcggatcctgccggatgctgataaatctgcagctcaaagtggcgggccatcgcgtagatatactcaaaaatcgctgcctgagtattttcataatcggcccagaaaatagaggaggtgaagcagtagatctctaccggcaatccatccggcgacggtttcagcggtcgcaccacgatatacatctctttctgaatgtcgtcacgctgcgccagccaggcggtcaggtatttacggaacaccatcagattggtgatgccgtttctccataaaccagcggtcgcccacggcattgatatcacgcccatccagcagctcagtgatcgattcgccagcgagacggatctggctcatcgcctgcagcatctcctgattcacaaaggtgatcgacttctgatcaagataaaagctgcgcatgatgcggcgtgcgcccgaggagaacatcgcctgccagttggtgtaggtctcggtcaggaagttcttggtcgggatgcgcgaaatggtgttgtcccagttgcggatggtgatggtatgcagagcaatatcgatcacttcaccactgatatttctgtccggcatctcaatccagtcgcccagttgcagcacatcgttagaggagagctgaatattcgccaccagcgacagcagcgtatgctggaaaatcagcatcagcaccgcggcgaccgcacccagcgaggagatgataatcgccggtgacttgttggacataatcgccagaatcatgatcgcggcgataatatgcaccaggattttgccgatctggatatagcctttgatcgagtgattcttgcgttttgatttgcgcgaataggagttgttaacaatctccagcacttcgttgaagaagatcgacagatagacaaaaaacaggatgccgcagatggtctgaatcgccactttcagattttcaggcaggcccggcataaactgcaggaaattgtagaccacaatcaccggcacaaaatttgacagcttctgagagaggcggacatctttatccagcggcacgccctttttgtggctgctgaaaaagaccttcctgatcactttgacgatgaaaaatttgcagatcaggtgagtgaccatcccggccataatcagcagcaacaggctgaagctgatcgacagtaccctgtttccctcaataaaactcatcagactctgaatgtaatgcatgataaccacgtgcaaaaaagataaggggcgaattcaaccacagcacggggacggttgttaagcgccgaatgcgttcaggctgagccgcaccgctttttttgcgtaacggcgcgctggcagcaccctccatcctgcggattgttaccttctctggtgcaacactcagataaacgccgcgctggccgataacagctttatctcctctgatatgagcctgcggacatgcttaaaaatcttaaaatcactcacggtatcgctgctgttctggtggtctttgtggcgttactgacgctgaccggatttctgttctataacggcgtctcaaaagccgacaaaaacttcgtggcggcagagcagcttacgctgcagcagcagcacctgagtgacgcggtaaaaaccctgatcaaaacccgcgtcactatcaaccgtgtggcaatccgtttcctgaaaaatcagcaggatccaaaatcactggcagctatggctgcgctgctggagcaggctggaaagtctgctgctgctgccgatgcggacttcaaagcctggcaggcgctgccgcgcaaagagggccagggtgaagcccaggcgacgcaggtgcagaccgcctaccagcagatgcgtgacaccatgctggcctcgattacctttctgaagcagggcaactacgcgggctacggcaaccttgaagcacaggcggcgcaggaccagctcgacagtgcctatgaggtctggcgtgcagtgaacatccagctgatgaaagcgtcctcggagcataaccagcgtagcctgacggatgcgctctgggcgcttctgactattggcctgatcaccggcgtgattggggtcgcggtctggattgggctgcagaaattgctgattggcccactgggcaggctgaccggccatatgcgcgccatttcaggcggtgatctgacctccgatattcagcatgaaggccgcaatgagatgggtctgctgattcaggaactgcagcagatgcgcgatgcgctggtggtgaccattacctcggtcgatgacgccacccgctctatctttaccggtgcagcggaaatctctgcgggcagcaccgatctctcttcccgtaccgaacagcaggctgccgcgctggaacagaccgcagccagtatggagcagctcacctcaacggtgaaactcaacgcagataatgcgcagcaggcgaccacggtagcgaaagaggcttcagccacggccctgcagggcggtgagactgtcgcccgggtcatcgccaacatggatcagatcagcgaaagctcgaatcagatcgccggtatcatcgccattatcgacagtattgccttccagaccaatattctggcgctgaacgccgccgttgaagccgcgcgtgccggtgagcagggtcgtggatttgcggtggttgccggagaagtgcgctcgctggccggacgcagcgccagcgccgcgcaggagatccggggactgattgaccgctcagctgagcggattaaaaccggtgccggtcatgcttctcaggcgggtgtcgcgatggagagcatcgtgacgtcggtgagccgtgtcacgcagctaatcgaagagatcgcggcctcctcgactgaacagacccgtggcattgagcaggtctgcaaagcggtctcggaaatggatggtgtgacgcagcagaacgccgcgctggtggaggagtccgcgactgccgccgcctcactggaagagcaggcgagctacctgcgtaaaacggtatcggtattcaaaaccggcactctgcaggtggcgtttctctgctgcgccggtggcgaaagcccttgccgtgccaaaacttcagcctgcccgcctggcggacaacgataactggcagaccttctgataaaaaaaaccgccccaagggcggttttttattttgtgacgcggcatgcggcatcgtgccgctgacatcaggccgggacggactgtgccttctggctgcgcgaccagacgcggtgcgctttcatcgcctgagtgaactcagacatcagcgcgctctccgccgagtcgccctgcacaataccttcttcctgatccgcatcttccagaccgaactgcgctttaaagcggcgcgcttcccccaccagaccaatcaccttgaggtgcttgtaggcttccagcaggaagtaacgggcatcgccgctcagcagcagggcatcgatattgccatccggcaccatcaccgcatcaaaggtcagagagggcagacctgcgaacgtcgcatcgaccggcagcaccgaaccatcatcggcgcgcacctggcccatatgcggagccagcagtttggcgtgaacacccaccgctttcagcccctgcaaaatcgccagcacatcagccgccttcacaccatcgctgagcagcagtgcgacctggcgacctttgatctcgccatccggaatggcgtagaggctcaggctgtcatctttggtcaggccattcaccggcgcaggcggctgaatgttgagctgctcatccgtcagagcgagtcccaggttatccgccacgccctgcgccagtttagtatcgatgcgtgccagatgatccaccacacgctcacggatataagcacgcgccactttactcagttcaaacgagtaggcaccaatgatgtgctgctgctcgacttcagtctggctcagccagaacaggcgcggctgcgcatagtactcaccaaatgaggggctgcgctcgcgcactttatggccctcaatccgctcctgatagctctcgaagccaccgccttctgcagcaggtggggtttcacgcggccagttatcgttgatcgagttcggctcgtagttcgccggattggtgtcgatatcctgacgatgcatgccctgacgctggaagttatggtacgggcaggtcggacggttgatcgggatctcatggaagtttggtccgcccagacgactgatttgcgtatcggtataggagaacaggcgaccctgcagcagcggatcgttggagaaatcgaggcccggcacgatatggcctgggtggaacgccacctgctcggtttcagcaaagaagttatccggattacggttaagtaccatcttgccgacaatctcaaccggcaccagcgcttccgggatcagcttggtggcatccagaatatcgaagtcaaatttgaactcatcctcttccgggatcagctgcaggcccagttcatattccgggaaatcacccgcttcaatggcttcccacagatcgcggcgatggaaatcgggatcgcgaccggtcagtttctgtgactcgtcccacagcagcgacgctttaccggccaccggcttccagtggaaacggacaaaggtcgctttaccttctgcgttaatcaggcggaaggtgtgaataccaaagccttccatggtgcgatagctgcgcggaataccccggtcagacatcgcccagatgacgttgtgcatggtttccggctgcagagagacgtaatcccagaaggtgtcatgggcgctctggccctgcgggatttcgttatgcggttccggtttaacggcgtgcacaaagtcagggaatttatgcgcatcctgaataaagaacaccggcgtgttgttgcccaccaggtcaaagacaccctcttcggtgtagaacttagcggcgaaaccgcgaatgtcacgcacggtatcagccgatcctgcaccgccctgaactgtagagaaacgcacgaaaaccggcgtggtctgctcgggatcgctgaggaactgtgctttggtcaaatctttcagggagcggtaaggctgaaaatagccgtgtgcggcagagccacgggcgtgaacgatacgttccgggatacgctcatggtcaaagtgcgtgattttctcacgcataataaagtcttccagcagcgtcggaccgcgcgaaaccggcacgcagtgagttttgatcgttggcgatgcgtgtgccctggttggtggtgagggcgcggtcggtgccgtttttgcggctggcttcaagctggtcaagtttggcgttgtgcgtctgaggcgctttcaggctgcctggggcggtgggctgcttgcctggcggagtcggttcggctgggggctgatgcgaaccatcttttggtgccagtgaacccagacccggctctgaggattccggaccggtggtgggggcgcgctcgctcaggggtttcttctctgtttctttcgacattaattcatgctccagctgttattttactttcgacgacactaaatatagaacaacctgaacaatactgaggttaaatcgggcatttaactgtgacgactgtgccttttttgtccgccagaaaagcgcacttatctctcaatccggattatcgcttcgcttattcatgccttgtgccgtctggcttaacggcgttccagcccgcgcctgctatacggaaagtgagctttcagaggatgcagaatctgccgccgcaggaggcgctcattgcctgatgcagggcattaaccgattaataaaattaatgctggcgtttgctgcttttggttgaagttagaaatgttatatcataacatttcattttgtaacgttgaccggggtatcagactttgatgaatcatgcaggtaaatggattgggctactgggcgcactgttagtcagccagccgtcgctggcacacggcacgcatgcacatggaaaaccgctgtcagccctggagcagaaagcggcagaaggggtttttgctgacagcgatgtgaaagatcgtccgctcgctgactgggatggcctgtggcagtcggtttatccgctgctgcaaagcggggagctggacccggtctggcagaagaaagcgcagcaggatcacagcaaaacggcagaggagtataaagcgtattaccgcaaaggctacgccaccgacgtcgataccatcggtattgaaaatggcgtgatggagttccacatcggcgaccaggtcagcgcctgccactaccggtatgcgggccacaaaatcctgacctatgcctcaggtaaaaaaggggtgcgctacctgtttgaatgccaggacgcgggcagcaaagcgccgaaatatgtgcagttcagcgaccacaccatcgggccgcgtaaatctgcccatttccatatctttatgggcaacgattctcagcaagccctgctggcagagatggataactggccgacctattatccttaccagatgatgaactcacaggtcgtggatgagatgctgcaccactgagagccgggccggtgtcagatgccccgcggatcagagctgtttcgcaaggatagcgactggattcatttcccccgtttgaggaaatatagatccttgagttaagttaactcatgagttaacttaactccaacggaggatctatgtttgagataacgatacacaaggacgcgctcactgaaattaaggcaatgccagagatgctccgggctaagctggcccggcaaatagataaactggctgcccgtggaactgatttgagagagccggataccaaaccgttagggtcgggtttttttgagctcagggcgaaggccaatgagattgggcgagcggtgtatgtttaccagaaaggcagacgtatttttatcctgaaagcttttgtgaaagagacaaagaaaacgccagcagcagtcatgacggcagcggcgcaccgtttagaggagatgttaaacgatgagtaagaaatcagttgtgtggacgacggcccgcaaagaaattttatctgatccggctgttcgcgaacattacgaggcagaagttcgggcagagcacctgcgcgagcagttagccaaatggcgggaaagcgccggaatgaccagcgctcaggtcgcggaggcgctcggtgtcagcccgtcggcagtgtcacgcaccgagcgtcgcgcagataaagccacagttgaaacactcgcccgctatgcccgtgcctgtggcgttgaaaatccccagatctctctttgattgagagatgacggcaggtgccagaacaatgctggccctgctatttatcttgcctgctatcaagcaaactttctttccggtgcacacgtatcccctccacgggttttatcccacccaggccgggcggcgcgaggcgggtatacccttaaccacacgctgataggaatcctctaccagctgctgaatcaagccaggcgagaggtcgtcaccgggatagaccgtgatccagtgacgtttattcatatgataaccggcggtgatcgagggatagatcacccggtgcagctccgcctgctgcggctcgcatttcagggtgataatcggcacaccccgcagtttcggtcagcagtaaaaacacttttccacacactttatagacctgatgttccggcccgaatggatagctgcattcagcggcgggcagccgctcagccgcttcaatggcgatgcgctggatctcatggccctgcatagtgagtctccctgtaattattcagcctgagtctgcggcccgcgactggctggtcgccaggggcctgttacacttctgataagcataaatcaggagcagacatgaaattaggctttgcatgtaagtatctcaacagcgatggcaaacagtttttcccgcttcgcgccaccacccgtaaacggtttctgagtttatcgcacgatgaacgcaatcagctgatctatgagattaccgtcaccaacctcaacaatctctacctgacgcttgagcatctggccaccttacctgagccactcaggatgatgcgtattggcagcgatctgttaccgctctatacggttcccgaggccacgccactgttcaccgaatttctgcctgaactctatccgctctttgcccgctgtggcgagctggcgcgggcgcatcacatccgtctctcattccatccaggacaatataccgtgctcgcctccgataatcccgatgtggtggtgcgcgcgctggaggatgtggagtatcacacgctctgcgcctgtctgatgggatatggcaagacctttcaggattttaaaatcaacattcatatgaatggcaaggcgggattcgacggcttcaaacggtcgtttaatcagctcagcccggaagcgcggcggatgctgacggtggagaatgatgagatctcctgctcgctggatgacgtgctgcaggcagcaccgctctgtccggtggtgctggatattcaccatcactgggtaaaagagagtgagtttattcagccggatgacgcgcgtgttgccagagtgatcgattcgtggcgcggcgtgcggccggtgctgcactattcgatttcgcaggaggggatgattccgcaggagggctggcccgatcagcagcagctgggcgtgagcaaaagcaagctgcgggcgcactctgactacttctttaacccgacgctgaatgcatgggcactgtcgtttcaggatttcgatatcatgtgcgaagtgaaaatgaagaatctggcgcgggaacaactctaccagtgggggataacacagaagctaatagctaatcccctggccgaagcgaccagggaatcggcgaacgttaaataatggccacaccgcccgtcacggcgatggtcgctcctgaaatgtagctggcttcatcactggccagcatcacataggttggtgccagttcagcaggctgaccggcacgctgcagcggcacttcgctgccaaagttcttcacctgttcaaccggcatggtcgacgggatcagtggcgtccagatagggccgggcgcgaccgcattggcacggatacctttttcagccagtaaggctgccaggccgccagagaaattaataatggcggctttggtggcggagtaggcgagcagcttcggtttcggctggtcagcattgatcgaggccgtattaatgatcgatccaccagcaggcatatgccgtgttgccgctttagtgatgtaaaacatcgcgtaaaggttggtcttcatggtccggtcaaactcttcgtcgctgatctcatccagcgattcgcgcgtcatctgatacgccgcgttgttcaccagaatattaatctcaccaaaggcttcgacggctttatcgaccagggcgttgcagtgtgacgcctcagtaatatcgccaggcaccagaaccgctttctgtcccgcttcttcaaccagccgggcggtatcctgcgcatcctcatgttcatcaagataagagatcaggacatcggccccttcccgggcaaaggcaatggcaacagcccggccaatgccggaatcgccaccggtaataatggcttttttccccgccaggcggccggagccctgataactctgctcgccgtgatcgggctgaggctgcatcgcagcggtagtgccaggccaggtctgctgctgttcggcaaaagggggttgtggacgctgagtggatgacatgactattcctccgtcaaaaggtgggacaagcctgtcagggcatcaaaccctgacaggcgagtaattacagtttcggtggtgtaacgccgtcaatctgctctgactgcgcaccagaaaaccgggacgcgcattgccgagcagcggctcatcacccagaatctctggctgctgtttcgcgctgaactgaccatggccatcgtaagccgggccactgctccagcgaccttccggcagcggtttatccagcgaggtattcagacagtagtaagagtgctcctgcgcctcatgctcctgcgggaagctgttcgggatcggcagcgacgcgttcagtccgcccatctcttcgatcaccgccagccactgctgctggtgcatattgtcacgggcgatcaggaaggagaggaagtccttcatgcccttgtcttccgtcatgttgtagaggcgggtcgccagtacgcggcccgtggcttctgcggtgacgttagccagcatatcggccgccacgttgccggacgcatagatatgactcatatcaaaaggcatgccgttggcgttaaccggcatcgctgccagaccggaagagaggatatggcgcgggttcattccacccagaattgcattaactaccggatctttcgctgacgcttcctggtaagagagcggggcgccttcaaggttaagtgccacggcgtagcccagcatttcgatatggctcagctcttcggtggcggtagagatcagcagatcacgaatccgcacatcaccgcgcgcgcccatcgcctggaaaaagtattgcatcgctacacgaatttcaccttcgacgccgccgatggcctgctggagcagcatggcaaattctggatcgggtttctctacacgaaccgggaattgaagttttgatgaatgatgaaacatgattattttcctcgtctgtgtttgcagtggatgcagaaaaagcctggacgcagatatcggataaataaagcgaaacgacagcaattaaccggaatttcaggttgaataaatggcgaaaacggtgttttccggagctatatctggtccggcggggcaggcaatcttagcggtgtgaaggggacaagtgattcagtgcaggagaaataaaaaaagccccataacaggggctgattccggacgggaaaagcatccatgctaattcgcgttccctcataacagacacagatttttagctctcgctggtcgccgaagcgcgctgcagaacatgttcaagcgcctgacggtaaatatcctgcttaaccacgtcacgctcactctccaggcggtgaatcaggcccagcacaatgtctttatcggagacatgggttttcgcatgggcaagttcggcatggactgcggcgataacctgtttttcagtggtcagcgctgtgccagagttcatgaagtaatcagaaatctgagactctgtattcatcgttgtttgcatgtcaggcctcataagaaatggggggaagaacgcgtcgattcagatccggtcaccggctgacgcaaaaaaaaatgcatctgaaggtggaaatccacaacaccttcagatgcggtgcaaagcacctttcgttacaagtgatttaacatcacgagacaaagttatacaagaatcgcaaagttgtacaatgaaatttgacaaaatttaactggtcggtggtgtatataaaaagcatgtttaaagtgaaaaaagaggttttcgatggttaattgaataaatacagtgagttggtgaggttttcagaggggtggcgattttcagaccagcaggctggggattgtgctgacgacacatcaacgcgttaaaaccgcttttttccgcagatttcagccaaagttgtacaggtttcaacgctggaaaagtggcgggtgcgattgtgctgctgcaatcctggccgtctgacaggccatgccgcataattcacttcccacgactgatgcagaaggctaaggttgaccccttatttatcacaaggaaatgatcatggttcacgactatttcgcaattccgcctgcgggcatgactcaggaacaacataaacgttcggtcgccgtggctgctgctctgtcagtggcaaaggagtccgtcagcgcctccacctcagcaaccggctcaaaaaccgcctgggatctgcaggccgtggcgaatgaagttgctaatctggccgacgcgattcaggatgcgctggagagtgacagcgaggtgtaaacactaaccggtatcgtctgaggctgctgcggaggcggtgcaggacagggcggtggcagcgtttcaggagccggtaaagtccggcaatcggacgctgccggaaaatccgcttattccattgcgggtggctcatatttaatatactgacgcagggcatcatggatagcctggttattgccctcttccagaccgcgttcggcatactctttcgccagcgccgccagtacatcgtcaaacttccctttgtaattgagattattcagcgcaatttgctgaccgagtatcgcttttaataccgtagtctcaacccttaactgcgcaactgtctcttcaagatgtttgattcgatcgtcgtctgccataatccctccatgcttaaaaaagcagaataaccagcccgcccgtaatattcaaacctctccgaatgccagagaagcgttgtcagattttccttaagtaaaaataatcagccggtgaatttataagattctttactgtaagaagaaatcgacgatattccggcggtgcggcgaaagtaacccgtttccgcttactctgacggcaatgcgaaaaaacgtttaaaaaaaagtgcattaccatcaaccctttcgcttaaagatgttccatgtcacttgattaaaagggggattagctattactgtgtttatatacagtaatctgaaaaaggagcgaaattatggaattcattaaacctgcggacattcgtgccgttatgcctttaccgctatatatcgaacgtgtgccgtgcgggtttccatccccggcgcaggattatgtcgaacaacgtattgatctcaatgcgctgatggtccagcaccccagcgccacctattttgtccgggtcagcggcgagtcaatgattgaggcgggcatcaatgatggtgacatgctggtggtcgacagttcactcaccgcctcacacggcgatattgtggtcgccgcggtcgaaggtgaattcaccgttaaacgtctccagcttcatccctgtctgcaactgatgccgatgaataccaaatttaaaccgatcgctatccagaccgaagatgcgctggaggtgtttggcgttgtgacctttgttattaaagcgacccactgaccatgttcgcgctggtcgacgtaaacagcttttacgcgtcgtgtgagaccgttttccggcccgatcttaaaggtaaaccggtagtagtgctgtcgaacaacgacggctgcgtgattgcgcgcagcgccgaggcaaagaaagccggcatcaaaatgggcgcgccctattttaaaatgcgtgaagaactaacgcgtcacgcggtgcaggtcttcagctcaaattatgcgctctacgccgacatgagccatcgggtgatgaccatactggaagagatggcgccatcggtggagatctactcgatcgacgaagcgtttatggatctcaccggcgtgcagaactgtatggcgctggagacctttggtcgtcaggtcagagaaacgaataggcaaagagacccatctgaccgtgggcgtcggcattgcacagactaaaacgctggccaagctggcgaattttgcggccaaaaagtggagcaaaaccggcggcattgtcgacctgtcggaccctgaacgacaaaaaaagctgctggcgcttattgatgtggcggaagtctggggcgtgggtcatcggatcggcaaacggctcaacgccatgggcgtcatgacggcgaaagatctggccgatcaaagcaccgaggccatccgcaaacagttcagcgtcgtgctggagcgcactgtcagagagcttcgtggcgaatcctgtctggagctggagtcagtgacgccggtaaaacagcaaatcatgtgttcgcgttcgtttggcagccgtatctccgactacgatcagatgcgcgaggctgtctgcgcgtatgccgagcgcgcggcggagaagctgcgccgtgagaatcaatattgccgtcaggtaggggtatttgtgcgcaccagtccgcatgcgactgacgaacccttttatggcaatcagtcgatggagcaactgctgattccgacacaggacacacgcgacatcatcagagttgcaatggcgtgcctggataacatctggattgagggacatcgctatatgaaggccggcatcgtgctgggggattttttcagccagggcgtggctcagtttgatctgtttgacgaacatcagccacgccgcaatagcgaagagctgatgaagctgatcgacacagtcaacaagctcggcagcgggaagttgtggtttgccgggcaggggatcaacaaagcctggtcgatgaaacgcgagatgctgtcgcctgcctataccacccggataaccgatctgcctgtggttgcgcttaagtgaaggctgacccgatgttcctctgctgctgaagccgcggcctctgctaaaagctttttttatcacgcgattaaagtggcgggaagttatgctttgcctgacccgatgagtagtttttcatcgggtattttaagcaaattaccaggtaaatataatggatttcaggcagtttgaagccagagtgatgctctggcccgcaatacatttcacagcaatcataaaatcccgccatcatgacgaatatgagatttatgcgatcgacgataacagcaatataaaaaaccgactctttgtatgttttgctgacaatgaaaaccacgccagcctgcttattaagcaatttacgttatggctgataaaaataaacgcgctgaagcgcagccagcagcgggaaaaaggccgcacagagacaacatccttatctgaatgaaccgcgtccggcttgcaccgcagaccagacggcggctggtcagacagcggcgaatcatactaacgcgtccgggaaataacgggccgtctgcgcgtgacgggtggcggacggcctggcttgttacccgcgcctgggatagaatcgccactgattttgacagcaacacacctccccaggccggtaacaatgaccacgacagccacaacgtataaaaaaaaagagcggggacgccccagagagttcgggatcgaacaggctctggatcacgccatgatcgttttccggcaaaaagggtatcacgcggcctcaatgaacgatctgggtgaggcgatgcatctctccgcaggcagcatctataaggcgtttaaagataagcgctcgctcttcctgctggtattcgaacgctatctgttgctgagaaatagtgagttgcaccgtcgtctggcaccctgtgccagcgggcgggggaaaataaccgagctactgcagtttctacctggattcggcacgtgccacagaagggcgttgcggctgtctggtcgtcgccagcgcgattgcgctgcagacgatggatcagccactcgcgcagcgcattgatgaggtcgttcagcgtaatcaacgcttcctggtctcgctgctggagctgggacaacaggatggatctatcgataacacgctggacagcgaggcggcagccggtttaattctctgtattgcttttggattgcgggtggcaggtaaggtcagcgatgtgactaacgaagaaaagacgctggcgctggcattgaaagtactggggtaaccaggcaaggccgctcaatcagtaaacagacttcccggacctgggcttccagacagagaaattctgcactttcctttcccctcatctgattatgtgccaggctttcacgctttatcctgtagcgaagaaaattaaggcgcgtttcgtgaaaacctcaatcttactgacacttgtggcagccattggctgttctgtttttgctgcccgtggtgggtttgaaacccctacagcgaaacatccaaaaacgatgcaggtgactgaaaacggggagccgctgacgcgctgagcgtgacggcaggtggggagaggccgacgaggaccggttaacggccagacagcaggctgatgagtgcagggtaatggcactcatcaatgggtgtggaagccgtttcaggctgtgaggccaggcgcgtgcccggcaccctaaaaataaacagcaatgacccgcacatgactaacgataatctttaagattaaccggtgcctgtccggtctcgaccagccagtttaattcggcacggtcgcgcgttgaggattcgataaaacctttgagccagttgcgcgcatcggcaatctgcgtgacccgctcatcgttgcgctcctgttcggccatttcgctcagctggcgaatcagtgctaccagcgtaatctcctgtttcgtcaaaagccagattaattgcagcttcaccaagaatcatatgacccgttgttttgtcgtgataaaccatctgcaccctcctgattaagtagcgatataaagagtctagttaaaggcgctctggactaaaaggtgggaaacagcagggcgctatgattaaaatttaccgaaaataaagtgaacctttaatcgaggcggtaaaccactcatatcaaagcataaaaacaggctgaggttttttgtgagaaataagatgagctattatgctggttaaaaaagctgggagttgccggaaattcagataagggcggaacggcgcatttcgttatcagattattatctgcaccactatccgcacggttgcctgccatattatggccacgccgtagcggatatttctgatttataaaccaccggggaataaaaccaggactgtgcaccacttcgtgccaggcgcaggcaaaaataaagccgcccatgggcggctttattcatcgggcaacagcgatcggattatttcttcggtacttcagagaccgctttaacgtccgctttattaatctgctgcttcacgccatttgcatcggtataagccagcaggccggcatccgattcagaaggcttgccatcactaataatggtgcgtccatcgttagtctgaatcgcataactggtacgggtgcagccggttaatacggtcataccaatcaatgcggcgagaggtaaaatcagcgcttttttcatcttattcaccttatattagttgtcgagttcactcatattactgatctcattacgattgatctgctcagtttttcctgtctgagcatcgcggtaagaaaccagaccagtatctgaatcaatctgcggtttgccatcggtgacaatcgtgcggccatcggtggtcttaatcgactggtttgaggcacaacctgccagcgtacctaaagagagagccagcaacgcaatggctgacagggatttcattttcattttttctgctccatgaagtatatccgaacgtttacagcatagtcggctttatcaggtttgctggccctgtcgcgtctcgctgcctgttttttaaacaaaaccggagtgtgtggtgctgattagggggtatgacggcgtgaaatagcatttattgcaaatgtacccagccgttctgtgccatttcagcagaggatgcgctgtaccgaaataagatcgatgctgatgcgggaaataagcacggcagccagagcggatatttccgtaaaagccagaatagcggtgcggaaatagtcagcatgtgggtgaatgtctggcgggattcacaggtccgataccctgaaggctatcggacccgtggagaaggggatcagaggatggagtcttcgcccgctttggcggccgctttttctgctttcatggcgctgaccgggtctgatgcgctcagccagcggtcaaatttctggtaggtgtcgataaaggttttaaagtagctgctggcgatggtggcattctctttgtggttcataaacgccactgccagcttaaatgcatcttcgttatcaaatttcatgtttgtcttcctcgcttaagatctatagagcgtagcctgagaaacgcggcctgtgcattcagacaaccgtctgaaaaggcgtaataattcagcctgactgacagcatctgccagattggcgtggattcccacttacttcgcgcgcaatccttcttataatgccagcttcactcgtgaaggagacccgcttatgttgaaaggattaaccgttgccgcggtgctactgctgtcaggctgtagcctgatgcataaacagccgccgtcgccgcagaccctgcactatcgctgcggaaccatgcccctgaccgtgacgctggacgaggcgcagcagcaggtcagtttcatcatggatgggcagcctctgacgctgaagcagacggtatccgcgtccggcgcacgctacagcgataacacctatgtgttctggtccaaaggaaacggcgcatttatcgaacgtaacgataaaattgtcgtgaatgattgtgagctgcaacctgccagctgacttgttatctgaataggcgagcattatgagcgacagcgaaacgctacacaccattgcccatctgcggcgtgaatatacccgcggtggattgcgtcgtaaggatctgccggacgatccgatcgcgctgtttgaacagtggctaagccaggcctgtgaggcaaaactgcccgatcctaccgccatgaccgtggcaaccgtagatgagcagggccagccatggcagcgtatcgtgctgctgaagcactacgatgcgcagggcatggtgttttacaccaacctcggcagccgtaaggcgctgcagctggtgcacaatccgcgcatctctctgcacttcccgtggcactatctggagcgtcaggtgatggtgctgggtgaagtggaaaaactgtcgcctctcgaggtgctgaaatatttccacagtcgtccgcgcgacagtcagattggtgcctgggtgtcgaagcaatcgagccgtatttcggcacgcggtattctggaaggaaagttcctggagcttaaacagaagttccagcagggcgaagtgccgctgcccagcttctggggtggctaccgggtgaaatttcacacgatggagttctggcagggtggcgaacatcgtctgcacgatcgtttcatctatcagcgcgatcacgacggctggaaaatcgaccgtctggcaccctgaatctgcacgattcgcccctatcagcgctggcacagaaagcgtcagcgctttatgctatagccctgatttttttcgattccgcaactcagcggaaagctgtgtaccagcataggtgcagtctgatcaatttggagtcagtaatgaccagcagtaacctgatacaacaattgcaggagaggggcctaatcgcccaggtgacggatgaagacgcgttaacagagaaactggcccaggggccaatttcgctctattgcggctttgaccccactgctgacagcttgcatttgggccatctggtaccgctgctctgcctgaagcgttttcaggatgccggccacaagccggtggcgctggtcggtggtgcaaccggcctgattggtgacccgagcttcaaagccgcagagcgtaaacttaataccagtgaaaccgtcaacgaatgggttgaaaagatccgccagcaggtggcgccattcctcgacttcgattgcggcagcaatagcgccatcgctgccaacaactacgactggtttggcggcatgaacgtgctgaccttcctgcgtgatatcggcaagcacttctccgttaaccagatgatcaacaaagaagcggtgaagcagcgtctgaaccgtgacgatcagggcatctcctttaccgagttctcctataatctgctgcagggctatgacttcgcctgtctgaacgagctgcacggtgtgtccctgcagattggtggttctgatcagtggggcaacatcacctccggtatcgatctgacccgtcgtctgcatcagaaccaggtctttggcctgaccgttccgctgatcaccaagtctgacggcaccaaattcggtaaaaccgaaggcggcgcagtctggctggatgcgaagaaaaccagcccgtacaagttctatcagttctggatcaacaccgcggatgctgacgtctatcgcttcctgaagttcttcaccttcctgagcatggaagagatcaacgcgctggaagaagaggacaaaaacagcggtaccgcgccacgtgcgcagtacgtgctggctgagcaggtgacgcgtctggtgcatggcgaagcgggtctgtctgcggcgaaacgcattactgccagcctcttctccggatccgtcagcgaaatgaccgaagccgattttgaacagctggcgcaggatggtatgccaactatcgtgctgggcgctgacgatgatctgcagcaggcgctggtgaaagcagagctggtgccgtcccgtggccaggcgcgcaccatgatcggctccaatgccgtttcactgaacggtgaaaagcagtccgatgcggagtaccgcttcagcgacagtgacaaactgtttaaccgctatacgctgctgcgtcgcggcaagaaacattactgcctgattaactggcagtaagatttcagggccggtttccggcccttttttatggcaaggcaggacagggcaaacaagtgaaaaatattttagcgattcagtcgcacgttgtttttggtcacgccggtaacgcggcggctgagtttccgatgcgccgtatgggcgcaaacgtctggccgctgaataccgtgcagttttccaaccatacgcaatatggccactggaccggcacggtgatgcctgcaacgcatttaaccgacattgttaaaggcattgctgacatcgaccgcctgaagacctgtgacgcggtcctgagcggatatctgggctcggcagagcagggcgagcagattctgcagattgtccgtcaggtcaaagcggccaacccgaatgcctggtacttctgcgatccggtcatgggccatccggagaaaggctgcatcgtggcgccgggtgtggcggagtttcactgtaaaatggcgatgcctgccagcgacattatcgccccgaacctgcttgaactggagatgctgagcgagcgcaccgtcacggacgtcgacgcggcggtagacgctgcgcgggcactgattgcccagggaccacgcgtggtgctggtgaagcatctggcgcgtgcgggtcgtcgcagcgatcgctttgaaatgttgctggtaacggctgaagatgcctggcacatcagccgtccgctggtcgatttcggtgtccgtcagccggtcggcgtgggcgatctcaccagcggtctgctgctggtgaatctgctgcacggcaaatcattgcaggatgcgctggagcatgtcaccgcagcggtatacgaggtgatgctgaaaacccatcagatgggcgaatatgaactgcagctggtggcggcacaggatgccatcgccacgccgacgcagcacttcgcggcagaaaaactgtaacgcatcagggccggataaccggccctgttgactcaggctaagccttccgccttaagcgccgcctgcaccgcaggacgttccgcgacacgatcaaaccacgcgcccagcgccgtaaagccggataaatccagtcccagcgcttttgcccagcgcgtcaccacaaacagataggcatccgccacgctgaaatgcagccccatcagccactgtttgtcgcgcagtgactcatcgacatagcggaattttgcttccagctggctgcgggtctgcgctttcacctcatcggagtaaccggggcgaaacagtggcccaaagcttttatgcagctcactgccgatgtagctgagccactccacggtgtgataacgcgtcaggctgccaaccggtgccagcagatggcgatcgggcttaagatccgccaggtactgaacaatggcaacgccttctgtcagcacagaaaccgtcgctgagctgcagcgcgggcacctggcctttaggattgatttggcggaagtcatcgccccgttcagtgatttttgtggccagatcaacactcacctgagtgaagtcgagtccgcattcacgcataacaatatggggtgagagagagcaggcacccgctttgcaaaacagtttcatgaccaggtactccttgttgcaatgggatccttgcatagtaaagagtcaaagcgggattaccagtgacaaagatcagggatctgcgaagggtgttgcggcaagccataaaaaaagccgggcagagcccggcttagctgaagtgcagcgtgaattacgcctgcccgttattttttttcgcgtcaggatcctgcgccatgcggttcagcatcggcgccgtaatcagcatcagcagggcgatcaccgccgtcacgataccaatctgctggaatacgcggctgtaagtcgccagcgaaatcagtggatcggtgacgttttccggcacggccatcaggtttgccactttaccggcaatcaccgccgcgccagcggtagtcaggaaccaggaacccatgataaagcccatcagacgctgaggcaccagctgtgccaccattgccaggccgaggccagagatcatcagctcaccgatactctgcagcgcatagctcaggatcagccagttaacggaaacgataccggcatcgctggcgaacttcgcacccaccggcagcaccaggaacgcagcggagcagagcaccataccaaaggcaaacttgtgcggcatcggcagtttatcgcccagcttgttgtagagcgccgccagcagcggactggccagcataatccagaacgggttcagcgcctggaactgctcgggggcaaaagtaatgccgagaatggtgtgctcaacgttgcggatagcaaagaagttgagtgacgttggcatctgcatataaagcacgaagaacagaatcgcttcgaccatcagcaggaaggcaacaatcatcttacgacgtgccgctccctgcagtgcaaaggcctctttggcaaacaccagcacgatacccagggcaatcacggccagcaccagtcgtgcgatagactggtgatgcagcatccagttggccagtgcgatcagtacgacgatgccgaccagcgtcatcagcagttttccgatctgcaacggagcgaaatcgggtttagaaccgtaatccttaaccatgcgtttgcagaacaggaagttaaacagggtgatgatcagaccgataacgcacagtgagaaggctacgctataaccatatttcgccgctaaccacggtgtcagcatcattgagaagagtgaaccgatgttgatcgacatatagaacatggtgaaagcaccgtcgagacgcggatcatctttgtcatagcaggtagagagcagcgaagaggggtttgccttaaacaggccgctacccaccgcgatggtcgccataccgatgtagacaatgctgacgttatgaccggagaaacgccaccagtgcatagcccagcgccagcaccaggacacccagtacgatgacgcgtttggtacccagcaccttatcaccgagccagccgccaatcgcgaccaggccatacaccagcgcactgaatgaagagaacagagtaatggagtctgattcagacaaccccagttgcttcaccaggtaaaccgccataatggcctgcaggccatagaagccaaaacgttcccataactcaatcgagaagattaagtagaacgccttcggctgtttaaacgcattgagactgacagcctcatcagtgtgtttgtttgcagttgacacatgtacctcagttttttcataccctgtttcgggacaggaattaagtccgcgtcatgtgagttttccatgcgcaagattgttattagaagggaaaagcggcgactaatttggctgattacgggcggcagggcaagaattttctgacaacccgcccgaccctggaatgttgggttaaaaaacttatagcaaactgttaattggtttttaattttgagtgtagggaaaatagcagcgcataagcgctggataagcccctagcactggagagtattaacattaactgctaatgcgtgattaaccagataaatagtttgctgaatgataatcaggcagcactaacggcaggttgctgattaattcacagtcaatctgccgaattatcggacattacacgcctggcattgccgcaaaaaccatcaaatgatgatcctgtgcacaaacagatgatttatttcagaaaggaaaaaaagaaaccggttgcgtcgtctcgtctgacgcgggagctgagggggctcgcaggcgcaggcaagataaaaatcagctcagcctgccggtgaaaagccgcccgtgcgtgttaaaaaacgtatcgcgataatccgctttcagcttgccctcgacagaaaattaacattactgtaacctctcaatttccccgagaaggatctgtttatgtcgtcccccctgcgtttatctctggttggtgactaccgcgccgaggcggttgcccatcaggctatcccccttgctattgaacgtgctgcccgctggctgaatatcaccgctgaagcggagtggatcgccactgaccgactggatgagtcagaaactgcaactcagcgatgccgtctgggtggtgcccggtagcccctatcgaaatgatgccggcgtgtttgacacactccgctgggtgcgtgaaaccggaaagccttttcttggctcctgcggtggattccagtatgcgctgatcgaatatgcgcgcaacgtactgggctggcaggatgccagtcatgccgagacggacaccgaggggaggatggtgattgccccgctgagctgttcgctggtggaacagcgcggcacggtgaggttcgaacccgggtcacgtattgccagagcctacggcgtgctggagagcgatgaaggttatcactgtaactttggtgttaacccggaattcagtgcagcgctgggcgataatacgctgcgcattactgcctgggacaaggcgggcgatgtgcgtggcgtcgagctaccggatcacccattctatgtcgccacgctgtttcagtcggaacgcgccgcactgcaggacaaagattctccgctggtgattgcctggatgcaggcggcgctggcgcaacgctaaacgcgatcaccctgtgacactgtcacagggcgatgctcgtcagcgcagcatggccgggcgttttgcgttaaaggaccagttatcgatcagaaactgcatgcccagcgcatcgtttcggtttttatccggtagcgagttgtagagtgcatgtgctgcttcaacccgttccatattcagggtaatccccagccctggcccctctggcagttccagatagccatcccgaatctgcggcgcatgctgcgtcagctgctgcccatcctgccagatccagtgggtatcaaaggcggtcaggcgatcaccgggtgcggctgcccccagatgcgccaccatcgccagcgacacgtcaaagtggttgtttgagtggcagccggtggtcaggccccactcatggcagagctgcgccacggtgtgtgcgttacgcatcgtccagaagtgtgggtcggccaggggaatgtcgatggcattgagctgcagcgcatgctgcaactgtcgccagtcattggcgatcatattcgtggcaaccggaatgccggtggcccgcctgaattctgccagcgtttcccgaccggaatagccatgctccgcgccgcagggatcttccagatagggaatgcggcccgccagctgtttgccataataaatggcctcatccagcgaccagctggcgttaggatcaaccgttacccgcgcctgcgggaagcgcgccagcagggcattgaccgtctccacttccacttcgccgtgatggactccgcccttgagtttgaaatcgcggaaaccatagcgatccgctgccgcctccgccagccgcaccacgccttccgcgtccatcgctttctcatgacgcagttgcagccaggcatcaccacccgcgtggcccgcctgatagttcatgctggtcaggttacggtcggcgatatagaacagatagccgaggaccggcacccgatcgcgctgcttgccgctggcaagtaactcggccaccggcagattcaggtgctgacccagcagatcaagcagcgccgcttcaatcgccgcggtggcgttgtaaaacttctccgggttcatctgcggaatatgaatgtcgtcggtatgcgcggtctgctggtgtcgcgcgtcgctggcaaacagcgtggcgatggtggcattcagccgcaggagtttcgctgccctcaatctgcggacgaaagcgctcaagcaacgccagcgttgaagcgtgacagggactttcgccgacgccggtacggccagccgagtcagtcaggatcaccaggatacgggtaaagtagcagttgtgtgcgccgccaatgttcagcagcatgctgtcatatccggcgaccggcactacccgcattgttttaatgactggactgtctgacatgttgattctccataggatcaagggaaggcggggatggcttgcggcgcagcagcagccacagcccggtcagcagcgagacgctggtcagggcatagagaccgccggtagtggagccggtcttcatctccagatagccaaacaccgtcggcgcgaagaagccgccaaggttgccaacggaattcaccagcgcaatgcccggcgcgacaatcgaggcgggcagctctccctgtggcatcggccagaaaaaggtcgcactgactttcgagccgatacaggccacgatcatcgccaggaagccaaaccacggggaacccagcgtggccataaaggtgccgcaggccgcgaccagcatggcgacacccagcgctttatcgagcttgtcgcggtggcggtctgaaaagcggctcagcagattaatagcaataatggcgcacagccagggcacggcggtgagaatgccgatgccaaaactgctgaagccctgaatgcgctgaataatctgcggcagccagaacaccagcgtatagccggtcatggtcatagtgaaaaagatcgcgcagaagaacagcaggctgcgattacgtagcagcgacatcttgcctggctcgcggttaagctcgtcacgctgcgtctcttcattctgcagctgctgcaccagcgcctgtttctccgcagcactcagccagcgtgcctcgccaggtcgtgacaccagcacccaggcggcgagaatgccgaccagcaccgacgcaccgccttcgagaaacatcacccacttccagcctgcaatccccatgaaattgtgcatcatcaggatcgcgccggtgatggggccggagaagagaaaggcgccagcggtggcactcagcaccatcgcggtggcgcggccgcgccaggtattgggcacccactgacgaaaatagaacagcacgccaggaaagaagcctgcttccgctacgccaagtaaaaaacgcagcaggtaaaactggatcggtgaggtgacgaaaccggtcaggaccaccaccagtccccaggtaatcataatgcgcgtcagccagacgcgggcgccgaagcgcttcatcatcaggttgctcggcacctcaaacagcgcatagccgataaaaaagaggcccgcgcccagcccaaaggccgccgcgctgatcccggcatcggttcgcaactccgctttgataaagccaatattggcgcggtcgatctggttaataatcagcatcaccaccagcatcgggatgatatgggtgaagaactttttgatggcggaggcgatcagctcatcgtgctgcggggacaaggcgctatccatcggtcttcctcgtgagaaacgtaaagaagagcaaagtgtagggcgctgaaaaggccagctctatgggcatccgcccaggagccgatgggcgtacggcctggacggttgtgttatcagtatgttacggagtggcgtgggcgaagcggcagagtaaaactgtggcagcgatcaacttctcaggaccagggttgaggggagacctgaatgccagaagtcgcgccgacagtgaaagatgtaacagtgcgggcagacaggtttcagccactgaactgacggcgctgggcaatctcttcagcacgcagcagcagcgcctgcaaatcatcctcgtcaatatccagcagttcaccgtcctgtaaagcctgatgcagatccgcacgcgtcagcgggaccggcatggctaccggatcgggtttaacttcttccggggccagcggatgcggatagcgacgaccggccagattattaaacagcagagccagcagggccagggtcagtgagttgagcaggatcggcgtcaggacaaaatgatatccaagctgctgcaccgaagggccgcccagaatagcggtcagcgcaacggcaccgccgggcggatgcagacagcgcagctggaacattaacaggatcgccacacaggctgcgacgccgcaggcaagggcaggatccgggatcagctggctgacggtaacgcccgccagcgctgacaggctgttgccgccgacgattgcccacggctgagccagcggactggcgggcagaccaaagagtaaaaccgccgaggcaccgaccggcgcgacaaaccacaggttcagttcgcccagcacccagtggctcagcaggctggtcaggatcaagccgataccggcacccagtccggcgatcaccacatgctttttactcactgccagcggatgtggccagaggcgcgccagaaacaggcgcagaggatggcttccggcagaagcgcttttgttcattactttactcactgtgtcataacattttcttatcgtcaggggcggcgattttccatcatcaacatcaatgtaacaacccgacaaactgtactgttattcgtacgaacagggagagcagcgaaaagggggatcgggcaggagacgcgttagcagaagtgatcgccggataataaaaaacccgccgcagcgggtctttcatcagtgcaatcactcgactttgtcgggatactcgcagagatcttcaatcaggcaggagccacagcggggtttacgcgctacgcaggtgtagcgaccgtgcagaatcagccagtgatggcaatcaaccttatacgccgccggaaccaccttcagcagcttctgctccacctcttccacattcttacccggcgcaaatttcgtccggttgctgacgcgaaagatatgggtatcgacggcaatcgtcggccagccaaaggcggtgttgagcaccacattggcggttttacggccgacaccgggcagggcttccagtgccgcacgatcttccggcacttcgccgttgtgctgctcaagcagaatgcggcaggttttaatcacattttccgctttgctgttaaacaggccgatggttttaatgtactccttcacgccatccacacccagcgccagcatcgcggcaggcgtattggccaccggatagagctttgcggtggctttgttcacgctgacatcggtcgcctgcgccgagagcagcaccgcgatcagcaactcaaacggcgtgctgaagttgagtttcggtggtcggatgcggattattctgctgcagccgacggagaatttcggtgcgtttggtctgattcacaccggtttcccgacagcgtcctgaggcggcgcggtttcggccgcctgagcacgcagtgctgcccgctgtttcatcttctgatcgatcagatatttacccgccagcatcatgcccagaccgataaaggcgcctggcggcagcatcgccagcagcattggcgagtcgaaatggaccacttcgatacgcagcgacttcgcccagggacctagcagctggtcggcaccgttaaacagcgtgccgctgccgataatttcgcgcagcgatcccagcaccaccatggcgcaggtcgcgcccatgccgatggcgaagccatccagcgcggcaagcgggatgctgcttttagaggcgacggcttcagcacggccaaccacgatgcagttggtcacgatcagcgggataaaaatccccagcgactgataaagaccataggcataggcgttgatcagcatctgtacgcagctcaccaccgaggcgatgatcatcacataaatcgggatacgaatttccgatggcacccagcggcgcgaggcggaaataaaactgttggtcagggtcagcaccagcgtggtcgccagacctaaacccagcgcgttggtggcggttgccgtgaccgccagcagcgggcagaggcccagcagctgcaccagcgctgagttgttcttccataatccaccgaacagcaggcttttagcttcactcatttgcgtctccacataccggtaacgaagagagtctctccggaagcgttttcattaacagcgcggtgcgtttggttgcattgaccaccgcgcgtggggtaatggtggcaccggtgaactgatcgaattcaccgccatctttcttaaccgcaaaagctttatccgccggaccatgaaccactttgccattaaagctgttgatccagtcagagatacgcagttcgatcttatcccccagaccgggcgtttcgtggtgttcaatcacccgcacgcccaatactttaccctggaaatcggcaccgaccagcatctgtatcgcaccagaatagccgtcaggtgcagtcgtctccagcgcagccgcgaccggctggccgcctttacgcgccaggaagagatgatgcggcgcactgttgcccagcgctgcatccgtgacaacgtaacagtcctgctggatgttgttgtcataaagctcaacaggcaccacctggtccagcaggtttttctgctgcaacagtgtctgatgttccaccgtcggcctggttaccgtatttaccactgccgtggcggcggtagtgatcgcagcaaaaatcgccagcgtaaccccgtttttgcgaatcgtctccagcatcgcttaatccttctgatggccgtaaacgcgcggctgggtgtagtaatcgatgagcggcacacagatgttcgccagcagcacagcaaacgctacgccatcgggataaccgccaaaactgcggatcagccagaccagcagtccaatcagtgcgccatacaccaggcggccacggttggtggttgaagcggtcaccggatcggtggcaatgaagaacgcacccagcatggtggcaccggagaaaagatgaatcagcgggctgttcagcgattctggtgagaagaaccagcccagcgtcgcgcagaaggccagtgacagcagcatggcggcagggacatgccagcggatagcatttttccaaagcaggaacaggccgccggccagataacccacgttaacccactgccagccgaggcccgccagcacgccgttgtaaatcggctgcgccagcagatgttcagcactgtgacccgcgcgtaaaccagttttaaacgtatcaagcggcgtcgcctggctgatgccatcaacacccatctgtagctgctgcatggtttcacccgccagcgtgtggccccggaacaccatgctcaggctgtccatcagcccgggtttgatcgcctgaagcgtatcgggcggcaaccagctggtcatctgcaccgggaaggagatgagcaggaccacatagccgaccatcgccgggttaaacgggttctggcccagtccgccatagagttgtttcgcaatgacgacagcaaacagggtaccgatcaccaccagccaccacggcgccagcggcggcaggctgataccgatcaggacggcggtcagcagcgccgagttatccgcgagggtgctggcaacgggcgctttgcgcagtcgcagaatcgctgcctctgtcagccaggcggtcagcgtcgccagtaagacctgtaaaaaggtgccgtagccaaagaaataacactgtgcagcaaaacctggcaccgcggccagcaccaccagcagcatgatattgccggtgctgcggcgattatgggtgtaaggagaacttgcgatacgaaaagccatttaatcctcaagcgtcgtagacgactgcgctttacgcgctttggcacgggcgatggcggcagcaatagcggccttgcgcgcatcatcgggttgattcagttcaggtgcctgttcaggttctgcattggcgttgtttgcctgctcctgggcctgctccgctttatccaccgcaaaatgcgcggcggtggccagtgcggcggcatcacgagaagcggcatccgcctcactttccgcctgtgcggctttcttctctttagcacgggcgatagcggcctgaaccgcggctttacgcggatcggtatcagcggcagcgtccggcgcagcctctgcagcgctgtcgcctgcggcctgtgcctcggcgttttcagcctgtgcggctttcttcgctttggcgcgggcgatagcggcctgaaccgcggctttacgcggatcggtttcagcggcggctggcgcagcctctgcagcgttgtcgcctgcggcctgcggttcctcggcggattcagcctgagcggctttcttcgctttggcgcgggcgatggcggcctgaaccgcggctttacgcggatcgctttcagcggcagcctctgcagcgctgtcgcctgcggcctgtggtgcctcggcgttttcagcctgtgcggctttcttcgctttggcgcgggcaatggcggcttctactgcggctttacgcggatcgacactggcctcagcctggttatccgccgcctcaaccggcactgttttcttcgctttcgcccgggcaatagccgcttcaaccgccgctttacgcggatcgacggtctgacgcgtcaccggctgggtttcagcctgcgcctcggcctgacgcagacgcgcctgcgcatggcgggcttcacgctgggcttcaagcgttgcctcatccggttcggccgtctggcgggctttcacccgcgctttggccgcagccagttcgctggtatcggtgcgggcaacgcgttgcttcgcctcttcatgacgcgcttcacgagcctgcttttcacgctccagtcgcgcctggcgtgcttcgaagcgtgctttggcttccagcgtgcgtttcgcttccagatcgatggcgcgcagttccgctttttcctgacggtaatattgcaccagcggaatattgctcgggcagacataggcgcaggcaccacattcgatgcagtcatcaatatggtgagcgcgcgctttatcgtgatcgccgccctggctgtaccagtaaagctgctgcggcagcagtttggccggacaggcatcggcacaggctgaacagcgaatgcaggactgctcttcgtcgttgttgcccatttcactggcagatggagccagaatacagttggtgatcttcaccactggcacatccagcgatggcagagtaaagcccatcagcggaccgcccatgatcaccatctgacgcggcgcaggcgtgaacccgacctggtgtaacagatggctgatcggggtgccgagacgactccagacgttacgcggctgggcaatcgcctcgccggtcagcgtcacaacgcgttcggtgatcggttcaccattaataatggcccgcttaaccgcccaagcggtgccgacgttctgcatcagcacgccgatatcggaggaacgcccgccgtgcggcacttccttcccggtcaggatgcgggtcaactgcttggcaccgccggagggatatttggtcgggatgacccggatgtgcagatcacgctcgctacccagcgcctgcttcagtgcggcaatggcttcaggcttgttatcttcaatgccaatcagcacctgttcagcctgtaacacccaggcgagaatacggctgccttccaggacttcggcagcgtagtcctgcatcagacgatcgtcagcggtgatataaggttcacactccgccgcgttaataatcagggttttaaccccgcgcaggccgcccttcagtttggtggcggtggggaaacccgcgccgccgagaccggcaatgccggcgtcgtgaatgcgctgaacaatgtcggcgcgcggatgctgacggtagtcaggcaagggatccagcggcatccagcggtcgtcgccatctggcgtcaggaaaatgcaaagctcagagagaccagaagggtgcgcggtcatatgctgaccgatatcttcaatcacgccggaggtgggcgcatggactggcagcatgcggccagtgccaaatgtcagaggctgaccgcgcagcactttgtcgccaggcgcaacgcagatctcaccttcatgtccgatatgctgtttcagtgggataataaaacggtgcggcaacggcagttttcgctgagcggcgtgccgttggactgggttttcatttccggcggatgaataccgccctgaaaatcccagaccttctcttttttcaggaagttaaacagattaagcatgagtttctaccgggatcacccgtacaggaatggtatttaaatcccacttccagttagctggcgtggtggcaaccggacgcatttcaatacagtcagtcgggcagggcgcgacacagagatcgcagccggtgcagacatcgctcagcacggtgtgcatggcgcgggttgccccgacaatcgcatccaccggacaggcctgaatacatttggtgcagccaatgcagttggcttcatcaataaacgccacggtgcgcaccggctctttcgccgtttcatcgccatcaatcggctgcggttcaacgttaagcagggctgccagcttgagcatggtctgctcaccacctggcgcgcatttattgatcgcttcaccattgttaccgaccgcatccgcatagggacgacagcccggatagccacactgaccgcactggctctgcggcaggatggcatcaatctgctcaacgataggatcttcttcgacctcaaagcggcgcgaggcgtaacccagcagcgcgccgaacaccaggctcagcgcacttaatacggcaacagcaatccagatcgcggtcatcagaatttcaccagaccgctgaagcccataaacgccagcgccatcaggcccgcggtaatcagggcgatggagttgcctttaaacggggcaggaacattagccagcaccagccgctcgcgcataccggcgaacagcaccatcaccagcgagaagccgatagaggcactgaaaccatacagcgcggcctgcataaaggtgtggttaaggttgacgctcagcagaggtacgcccagcaccgcacagttggtggtgatcagcggcagaaagatacccagcagacgatagagcgacgggctggttttacgcaccaccatttcggtgaactgcaccacgacggcgatcaccaggatataggccatggtacgcagatagaccagatccagcggcagcaggatcagatggttgaccagccatgcgcagatcgaggccagggtaatgacgaatgtcgtggcgaggcccatgccaatcgccgtttccagttttttggaaacgcccataaaaggacacaggccgagaaacttcactaatacgaagttattcaccagcacggtgccaacaaagagaagcagataatcggtcattttttcgcctgggagccagaaagcggcttattatcattgatagcgcggcgtatctcaacacctgcgccatctgctgagcggcagaccgcactcagaattaaattcctgacataactcacagcgttatggcgcgataaaggtcgtttttacccgttttgagcgtttgaagtagggcgcaaacaccgcagcggccagcagcgacagcagtaatgtctggagggcacggctatcggtaaccggcgtaaaggcaaaggttttcagcgccagcagcacagtaatcagcagccagagcaggtagtgacgcggcaggcggcgggagcgcttaaagaacagccagctgatccagagactataagcccagaccgccacggcggtgagcagggaaatagcccagtaagagaagagtgtgctgccgtgagaaaatagcgccacacgccattccggattaaacagtggtgtcagatacatcgccagcaccagaaacggtggttaacagggtcattatcagccaggccagcggcagcaaaagccagccaccaatacgcggcgcagcaacctgttcattcatcgtggttattcctgtctcggggagtcgaagcgcagcagaataacatgtccagaggggcacgcccatccggacaagatcagcgggataaacagcgataaatcagccggaaatcagaccacgtagcgccacaccgttttagggacacagccgagatcatataaccgtccgccagagaccaattcagcacgtcggtgatcggcagcccggtacatattgatgatttccagatcattcgtcagggagtaattaagatgatcgaaaagcttttccagactgtctgaattatttactttgcggaatttaagcaggtaatcgtgcgcagtcatcattgccataacagatagaagtaacaaaggagtgctcagtatagggggcaagcttatgctgtccagatcatgcggcttaaaaaaggcgaaaatcagataaaagcaccttattagtcactaaaactccatatctggcttttttactattgtctgagccagcaactcagcgtctctatcttaaacacctcactaacttattacggacagagccggcataaagcgtttaaaagcagaggttaaatattatttttttcttattcagcgctgacaatgcattagtggcttctttctcacccttttagcccaaaaaaattaaccattctgcacttagtgccagagaaacgtttcgcgcctgactcaggccagcgatctactgtgcggactatcacaaatcccattttttgttcatcgcaggccggataacccgttttgtacgcctggctgtaatcgtttccagttgcagtaagcataagcgattctgtttattacaattatttaacgagcagattttttctgctcagccgttttatccataactcccccgtcagccaaaccgtgtgactacacgtaacccctttaaattgctctgttttgtgaagtgtgtcgccattatgcacccttttttagtccagtctaagcaggctctctaccctaaacagcaaacgcctttcagaggattaaaaactatgtggaaacgtttacttctgaccacgctggtcagcgccgcgttaaccggcccggtactcgctgcagatatgacggtcggcttctcgcaggtaggttcggaatctggctggcgttcggcggaaaccaacgtagcgaaaagcgaagccaaaaaacgcggaatcaccctgaaaatcgccgacggacagcagaaacaagagaatcagatcaaggcggtacgttcgttcatcgctcagggcgttgatgccatcttcatcgcaccggtggtgcagaccggctgggagccggtactggaagaagccaaagatgccaaaatcccggtttacctgctggaccgcgccattgtggtaaaagacaaatcgctctatcaggcggtggtgacggctgacaacgtgctggaaggcaagctgattggcgactggctggtgaaaaccgtgggcgacaagcagtgtaacgtggtggaactgcagggcacggtgggtgccagcgtggcaattgatcgtaagaaaggctttgctgaagcgatcagcaaccatccaaacattaaagtgatccgctcgcagtcgggtgactttacccgcagtaagggtaaagaggtgatggagagctttatcaaggcggagaacaacggcaaaaacatctgcatggtttacgcgcataacgatgatatggcgatcggtgccattcaggcgattaaagaagctggcctgaaaccgggcaaagatattctgaccggctcgattgatggtgtaccggatatctataaagcgatgctggcgggtgaggctaacgccaacgtggagctgacgccaaacatggctggcccggcgtttgatgcgctggaaaaattcaagaaagatggcacgctgccgccaaaagtgatcaagaccgaatctaagctgttcctgcctgccgacgcgcagaaggagctggataccaaaaaaggcatgggttactgattcaccgatcagccgcagaccagccgcagaccgccctacggggcggtttttcatgacgtgaggcggagtgagcagaatgaccacgcaaaatgaaacaccgctgttatccatcagcggcgtcagcaaaggttttcccggcgtcaaagcgctgaataatgtttcctttgatatccgtaaaggggagatcatggcgctgctgggggagaacggtgccggcaaatccaccctgattaaagtgctgaccggtgtttacagccgtgatgcagggactatcaccctgaatggtgagccgattacgccgcataatacggcgcaggcgcaggagatgggcatcggcaccgtttatcaggaagtaaatatgctgccgaacatgtcggtggcagataacctctatattggccgcgaaccgcgccgctttggcatgatcgaccgtcgccggatggtgcgggaggccgatgcgctgatgcggaattatggtttttccctcgatgtgacacgtccgctgggccactactcggtggcgatgcagcagattatcgccatctgccgcgcggtcgatctttccgcccaggttttgatcctggatgagccgacagccagtctggatgccagcgaggttgagatgctgtttaccctgatggcgcagttaaaagccaaagggatgagcctgatttttgtgacgcactttctcgaccaggtgtaccgcattactgaccggattaccgtgctgcgtaacgggcagtttatcgccacccgcgataccgccacgctgccgcagattgagctgattaagctgatgctgggtcgcgaactgctggagacggcgctgcagcggcagggcagcacgctgcgcagcaatcagccggtggtgtcgtttgaggattacggcaggaaaggcaccatcgagccctttaacctggaagtttcgtccaggcgaagtagtgggactggcggggctgctgggttcgggccgcaccgaaaccgccgaggtgttgtttggtattcgtcgtgccgaccgaggaacagcgaagatcaaaggcaaggtgcagcgcattactaatccggcgaaagcctcgcagctgggcatgggtttttgcccggaagatcgtaagactgacgggattatcggcgcggcctcggttcgtgaaaatattattctggcgttgcaggcgcagcgcggctggctacggccaattaagaagcgtgagcagcaggcgattgccgatcgttttatcaagagtctgggtattcgtacgccgcatgcagagcagcctgtggagctgttatcgggcggcaaccagcagaaggtgctgctgtcgcgctggctggtgaccaaaccgcagtttttaatcctcgacgaaccgacgcgcggcattgatgtgggcgcgcacgccgagattatccgtttaattgaatccctgtgcgccgatggtctggcgctgctggtgatctcctctgaactcgaagagctggtcggttatgccgatcgggtgttgattatgcgcgatctgaagcaggtggcagaaattccgctggagcagctttcggtagcgtcgatcgtcaatgctatcgcggacggaggggtaaaacatgcttgagtcccctatgacatctgaaaaaacgccacgtcgtaagctgaaactcccgccagggatgccgcaaatcgccgcgctgctgttggtgctgttgattgacagtctggtggccaataacttttttgccgtgcatctgcaggatgggcgtctgttcggcagtccgatcgatattcttaaccgtgcggcaccggttgccctgctggcgatcgggatgacgctggtgatcgccaccggcggcatcgatctttccgtgggtgcggtgatggcgatagcaggcgcgacggctgcgacattgaccgtagccggacacggtgtgccgtttattattctctgcacgctgggaaccggtttagcctgtggcgtatggaatggcgtgctggtggcgctgctgcgtattcagccatttgttgccacgctgattctgatggtcgccgggcgcggaatcgctcagctgattacgcaggggcagattgtgacgttcgacagtgacagtcttggctggtttggtaacggctcgctgtggatgttgccggtcccggtctggatcacactggtggtagcgctggcggtctggttgctgacgcgcaaaaccgcgctgggtctgtttatcgaagctgttgggattaatctgcgcgcggcccgtaacgcgggtgtgacaggctggctggtggtgatgtcaacctacgccataagtggcgtttgtgccgctgttgcggggctgatcgtcgcggcggatattcgcggtgcggatgccaataacgccggattatggctggagctggatgcgattctcgccgtggtgattggcggtgcgtcgctgatgggtggccgttttaatctggtgttgtcgctgatcggcgcgctgattattcagtcgatgaataccgggattttgctctccggcttcccgcctgagctgaatcaggtggtgaaagcggtggtggtgatgtgcgtgctgttgctgcagtcaccacggtttattgcgatgttgaaacggagacgcccgacatgattaaacgtcatcttccgctgatgatcaccttgctggtgtttgtggcgggttacctgttttgtctgagtcagtttccgggctttgcctccacccgggtaatctgcaatattctgaccgataatgctttccttgggattatcgccgtcggcatgaccttcgtgattttatcgggcggtatcgatctgtctgtgggtgcagtgatcgcctttaccggcgtgtttcttgcccgggcgatcggtgattttcatatcgatcccttgctggcctttgcgctgattctgtcactgggcgcgctgttcggcgccatgatgggctggctgatcgatgcactgaagattccggcatttatcattacgctggcggggatgtttttcctgcgcggatgcagttatctggtgtcggagaactcaattcctatcgatcatccgttctacagcatgctttccagtctggcgtggaaagtgccgggcggtgggcgtctcagcctgctggcggtgattatgctggtggtggtgtttggcgggattattctggcgcaccgcacgcgctttggtaaccgggtttacgccatcggtggcaatatgacatccgcccagctgatgggcgtttcgacccgtgcgaccaccattaagatttatatgctttccaccacgctggcgacgctggccgggatcgtgttctcgatttatacctcggcaggttatgcgctggcagggctgggtgtggagctggatgcgatcgcgtcagtggtgattggcggcacgctgctgtcgggtggtgtcggtacagttttgggcacgctgttcggtgtgttgattcaggggctgattcagacctggattaacttcgacggtacgctgagttcctggtggaccaagatcgccatcggaattctgctgtttgcgtttatcgccctgcagcggttactgacggtcatctgggatcgtcagcagaaacgcgcccgttaagcgattaccttcctgagttcttcagtactccgatcaatggcggctcgcaggagccgccttttactgcgcaagacgcagcaccatgaccgtgacctcttcacccgcgatttgccgctgttccaccgcctgccatcctgaacgctgatagtacgcctgttgatcgggtgtatagagccacagttcacccatctgctgttgtctggctcgcgcaatcgcctgctgtattaacgcttttgccacgccctgaccccggaatgccttgtccgtcaccacctcaccaatccagaattctcgtgccggaatgtcatccagttcatagcgaatgacgctacaggtcgcgaccaccgtttcgccatccggtgtggcaataagagtaaattctgccgaaggtttctgattgcgctgttttaaacgctcaaggatggcaggcgggtgagaccatgcaggaagatgtgaccattcagtgtgcaacagttgtgcggtttgtccggcgaagccgggatgttggtttagctcggcaatgtgcatggcgctggcgacctttgttttgtcaggctacaagcaatacaggctggtgggggaaagtgcaagttcatgaaagggttaagttatagcaaagacttaggttctcttttgtatgacagtaaaaacaatcgctattggatttaggtgcaaggtcaggaaaggtatgcctgatcgcaaaggattcccgcatccatgcggatcggccgcgtcatccctggcgcggacgctttgctcttcaggcatatctttccttcccggttgggctgatgcatcgctttaagaagcaggacagtggatatttctattgatggtggattaattcaaattgctgttggctgatgagaaaggtcaggaaagatatgcctgatcgcaaaggattcccgcatccatgcggatcggccgcgtcatccctggcgcggacgctttgctcttcaggcatatctttccttcccggttgggctgatgcatcgctttaagaagcaggacagtggatatttctattgatggtggattaattcaaattgctgttggctgatgagaaaggtcaggaaagatatgcctgatcgcaaaggattcccgcatccatgcggatcggccgcgccatccctggcacggacgctttgcttttcaggcatacctttccttcccggttgggcttgatcatggctttaaaaacatgcgctgaactatcaaaattatggaacgcccgtcattcccgactgaatagcatagtatttatcaaaaaccgatgccgcataatcctgcgtcagccgtttcattaacttacttaagagcgctgttaattaaaaaattgaacagcgccctttagttattaacgtttcaaacggtaatacgcttcgttccagcgcagtgcgtctttaaacgcaggtaaacgcgtgtgctcatcaatcaccagcacttcgatatcgttcatctcaccgtacagatacatatcatccagcgtcagcgcctggctgaacaccgtatggtgcgcgccgccgcccagaatccacgcttcggatgccgttgccagtgacggctgggctttccacagtgcgcgcgcaaccggcaacttcggcagcggtttcggctgtttcgatagcatccaccacgttaaccagcagacggaaacgatcacccatatcaattacgctggcgttaatcgcgcgacccgctggcgttgagaaaatcatgcgcgccggatcggctttatcaccaatgcccaggaactgcacatcgatcaatggcttctcttcaatggcaatcgacgggcagacctccagcatatgcgagccgagaaccagatcgttaccgggtgagaagtgataggtgtaatcctccataaaggaggtgccacctttgcgatcgcctgccagcactttgaaaatgcgcagcagcgcagcggtcttccagtcaccttcacctgcgaagccatagccctgacccatcagacgctgaaccgccagacctggcaactgcgtcatgccatgcagcgtctggaagttggtggtgaaagcgtggcagccttctgcttccaggaaacgcttcagacccagctcgatgcgcgcggcatccagcacgttctgacgcttttcgccgccggaagcggcaacatcggtaaagcgataaaggctttcatattcatcgaccagcgcattcacgtcgccatcgctgacgccattgatcacctcaaccagatcgccgacgccccagccattcaccgaataaccgaactgaatctgcgcggcgactttatcgccttcggtcacggccacttcacgcatgttgtcgccaaaacgcgcaactttcagctgctgactggcctgttttgtcagtgctgcacgcatccagttgccgaggcgctgctggctggcgctatcctgccagtgaccggtcaccacgctgtgctgcaggcccatacgggcgccgatgaaaccgaactcgcggccgccgtgtgcggtctggttcaggttcataaagtccatgtccatgctgtcccacggaatctccgcattgaactgggtatggaattgcagcagcggcttattcagcacgctcagaccaccgatccacattttggccggggagaaggtgtgcagccaggtaatgataccgacgcactccttgtcataattggcgtcgcgacacagagccagcgcttcatccggtgacttaaccagcggtttcagctccagacgcagcggtaaaccggcctgatttaaaccctctaccacctgacgtgcattctgttcaacctggcgtaacgtctccgccccgtagaggtgctgcgtgccgatgacaaaccacacgctgtagctgtttgactgttccataaaatcactcctttactttgagcctacctcaataggctattttatttgttagtctgaacctgggcagtgctcacacaggctgctttagcaacctgaacgcccgtcagggcggccctgaaagggcgagcgtagcgagtcatcctcacgtactccgtgtactacggattgttccgcgctgtccgtgtccagactgcctgcaacattacgcctgctgagataggctcttagcggaagcggggcgtgcggcgtattgcggttcagccgccacgcaccattgttgatagcgttgataaagttgttgatagcgtgcgacgcgcgccggatcgggctgcagcgtcacggcaatcgggctggccatcacctgctgggcgtcgggaaacgctggcatgcacaccggcggcgacggcggcgaaaatagccgcacccagcgcacagcactcgtcagaagcgacgatatccagtgggcggttcatcacatcgcagcaggcctgcataatcgccggggatttccgcgcgatgccgcccagggtcagaatgctctcgaccgggatctgctgttgctcgaagcactccataattgcgcgtgcaccaaatgcggtggcggcgaccagaccaccaaacagggcgggggcatcggtgcccagattgaggtcggtaatcacccctttcagccgctgattagcatttggcgtgcggcgaccgttaaaccagtccagcaccaccggcagatggtcgagctgcgggtttgcggcccaggcctcggtcagatctttaatcagactcttttgcatctcagccagctgaggcttcagctccggatgctgctgcgccgccagctgcagcggccagcccagtaaacggctgaaccaggcgtagatatcaccaaaggcagactgacccgcctccagcccgatagcgcctggcattacgctgccatcgacctgaccacagatgcctttgatgtcgcgatcgccgaccttttcactatccgcaatcaggatgtcgcaggtcgaggtgccgatcactttcaccagggtatagggtttggcaccgccaccgaccgcgcccatatggcagtcaaatgcgccacccgaaagcgtcacggtttgcgtcaggccaagacgctgcgcccattcagggctaagcgtgccgacaggcagatcagcggtccaggtatcggtaaacaggggagagtcgagctgttgcgttaacagcgggtccagcgcattgagaaaatccacatcgggcaggccgttccagtcgccgtgccacagcgccttgtgcccggccgcacagcgcccccgacgcaatttgtcaggtgcggtggtgccgcttaacagggctggcacccagtcgcacagctcgacccaggagacagcggcgtcacgcacggccgcatcttcacgcgacacgtgcagaatcttcgcccagaaccactcagaggagtaaattccgccaatatagcggctgtaatcctggaagcggccgctgtggcacagctgattaatctcttctgcttcttctatagcggtgtgatctttccacaacacaaacatcgcgttggggttgtcggcgaactccggacgcagcgccagcacgttgccgtcgcggtcaataggggcaggggtcgaaccggtgctgtcaacaccaatgccgaccacggcgttgcgctgatcttcactcagtgcattcagcacgccgagcagcgcctgctccatggcgtcgatgtaatcctgtggatggtgacgaaaacggttagtgtgcggatcgctgtataagccctgttgccagcgcggatagctgaacaccgcactctgcagctctttgccgctatgacaatccacggccagcgcacgcaccgaatcactaccaaagtccagcccaagggtgatggctccagcacgcatcggaatctcctgtagttagttaactcctgtatcctgggttcggcgcgccaaatcagttagtcatcgctggctgacaatatgcacttttctgtcatcggcagtgattttgtgatccattgcaaaagttaaggtccggttaaatttgctgaatatatggatcattttgtcgtgattttaagatgtgataccgctctacatttttcttcgctaataccgctaaaactagcccagcgtctggacagtctgtcagcacatgccagcctaacgcactgatttatggctgtacccacaaaacaaaacaaactggtagcgtttacaccgattcgttattagcagcgaaaaataacctggtaccggagagcatcatgcataaattcactaaagcgttcgcggccatcggcctggcagcggttatgtcacaatccgctatcgccgagaccatgaagctgggattcttagtcaagcaaccagaagaaccctggttccagactgaatggaaattcgccgacaaagcgggcaaagatcttggctttgatgtcattaaaattgccgtgccggatggtgaaaaaaccctgaatgccatcgacagcctggcggctaacggcgcgaaaggttttgttatctgtacgcccgatccgaaactcggctctgccatcatggcaaaagcgcgtggctacggtctgaaagtcatcgcggtcgatgaccagtttcgtcaccgccaaaggcaaaccaatggataccgtgccgctggtgatgatggctgcgaccaaaattggtgagcgtcagggtcaggaactctataaagagatgcagaaacgcggctgggatgtgaaaaccaccggcgtgatggcgattaccgctaacgaactcgacaccgctcgtcgtcgtaccggcggctccatggacgccatcaaagccgctggcttcccggcagcgcagatctaccaggtccccaccaaatctaacgacatccctggcgcgtttgacgccggtaactctctgctggttcagcatcctgaagtcaaacactggctgattgtcggcatgaacgacaacaccgtgctgggcggcgtgcgtgcgaccgaaggtcagggctttaaagccgctgacgtcatcggtatcggcatcaacggcgtggatgccatcagtgaactgtcgaaagagaaggcaaccggcttctacggatcgctgctgccaagcccggatatccacggctacaaaagcagccagatgctctacaactgggtcagcaaaggtgaagagccaccgaaattcaccgaagttaccgatgtggtgctgatcacccgtgacaacttcaaaactgaactggcgaaaaaaggactgatgtaaccctgagcctgccaggcagtttgtcgcctggcatccttaatagccaatttcgcgccgcccgccataaccggccggtggcgcgaaagagtgaggaaaaacatgaacactgattcagcatttctgtcgtttcatggcatcagtaaaaccttccctggcgtcaaagcgttgcaggatatctccttcgactgccgtggcggtgaagtccatgctctgatgggcgagaacggcgcaggcaaatcgacgctgttaaaaatactcagcggcagttatcagccgagcggcggtgagattcgtattaaaggccagccgatgagctttcagcgcaccaccgatgcgctggacgcgggcgtcgccattatttaccaggaactgcatctggtgccggaaatgagcgtggcagagaacatctatctcggtcagatcccgcacaaacatgggctggtcaaccgtaagctgatgcgttttgaggcgggcctgcaactgaaaaatctcggcatggatatcgatcccgatatgccgctgaaatatctgtcgctggggcagtggcagatggtggagattgccaaagcgctggcgcgtaacgcgcgtattatcgcctttgatgagccaaccagctccctgtcggcgcgtgaaatcgacaacctgttccgcgtcatccgtcagctccgtgaggagggccgggtggtgctctacgtttcacaccgcatggaggagatcttcgccctcagcgatgccatcaccgtctttaaagatggccgctacgtgcggacgtttaccgatatggctaacacccatcacgacgatctggtgcaggcgatggtgggacgaaaccttggtgatatctatggctattcaccgcgtgccaaaggcgcggtgcggctggagctggacaaggtcgaagcgaagggcgtgcggacgccgatttcgctgaaagtccatgccggtgaaatcgtcggcctgtttggcctggtcggtgccggtcgcagtgaactgctgaaagggctgtttggcggcacgcgtctgcgcggcggtcaggtgattctggacggcaaaccgctgccgctgcgggagccgatcgatgccatccgtgcgggcatcatgctctgcccggaagatcgcaaagccgagggcattattccggtgcattcggtgcgcgacaacatcaacatcagcgcccgtcgtcataaccttactgcgggctgcctgattaaaaacggctgggaaaataaaaatgccgacagccatatccgctcgctaaacatcaaaacgcccagcgccgatcagctgatcatgaacctttccggcggcaaccagcagaaggcgattctgggacgctggctgtcagaggatatgaaagtgatcctgctggatgagccaacgcgcggtatcgatgtcggtgccaagcatgaaatctataacctgatttatcagctggcgaaccggggcattgcagtgctgttcgcctccagcgatttaccggaagtgatgggcctggccgatcgcatcgtggtgatgcgcgaaggtgccattgccggtgaactgctacacgacgacgccacggaacagcagacgctgagcctggcgatgcccaaaaccactcaagcggccgccgtggcctgacaggagatcatcatggcttcatccacgacctcaaatacgccgcagcccgcttcacgcggcggcctgcagttaggtcgcatctgggacaacttcggcatgctggtggtatttgcactgctgtttattgtctgtgcgatctttgtgccgaacttcggctcgtttatcaatatgaaaggcttagggctggcaatgtcgatgtccggcatggtcgcctgcggcatgctgttctgtctggcttccggtgattttgacctgtcggtcgcttccgtcatcgcctgtgcgggtgtggttaccgccgtggtgattaacatgaccgaaagcctgtggattggcgtgggtgccggcctggttctcggtatgatcaccggctttatcaacggctttgtcattgcccgactcaagatcaatgcgctgatcaccacgctggcgaccatgcagattgtccgcggcctggcctatatcttctctgacggtaaagcggtcggtatcgaagatgagcgtttcttcgaactgggctttgccaactggcttggcgtgcccgctcccatctggctgactctggccaccatgctgatcttcggcttcctgctcaacaaaaccacctttggccgtaacaccctggcaattggcggcaatgaagaagccgcacgtctggccggtgtgccggtggtgcgcacccgcatcatcatctttatcctctccggtctggtttcagcggcggcgggcatcattctggcgtcacgtatgaccagcggccagccaatgacctccatcggctatgagctggtggtgatttctgcctgcgtgctgggtggcgtttcgctgaagggcggcatcggtaaaatctcctatgtggtggcaggggtgctgatcctcggcacggtagagaatgcgatgaatttattgaatatctcgccattctcacagtatgtggtacgcggtctgatactgttagctgcggtgatttttgaccgttacaaacagaaaaaagcctgattgagcgagccgttggtccgcagaggcagaagcctctgcgggctatccgaacaataacagactgagtgaggacgctatgtatcaccgcgaattaccggccgagcagcaaaaccccttgttgccgggctattcattcaatgcctggctggtggcggggctgacgccgatcaccgccgatggtccgctcgatttctttatcgatcgcccgcacggcatgaaaggttacattctgaatctcactatcaaaggtaaagggcgggtatttgacggcgagcgggcatttgactgcgaacctggcgaaatgctgctgtttcagccgaaaacggctcactattatggtcgcgcgccggacagcccgcagtggtttcaccgctgggtctatttccgtccgcgcgcctactggcacgactggctgcgctggcaggatgagcaggagggcgtgggacgtctgctgctgcctgaatcgctgcgcggcgaatttgatcgcctgtttgccagtatcgaacagacccacaattcgggccgtcgctttgcagaagagctggcgatgaacctgctggaaacggctgctgctgcgcgccgttgaagaagatccacgcagccatcagttaattcgcgatccacgcgtgattgaagcctgccagtacgtcaccaaccatctcgccagcgaggttaagattgaagaggtggcgcgccacgtctgtctgtcgccgtctcggctcgcgcacctgttccgcgagcagatgggtgtgaacctgctgcgctggcgtgaagatcagcgtgtaatccgcgcgaaactgctgctgcagaccacccaggagccgatcgcctcggtaggacgtgaagtgggctatgacgatcagctctacttctcgcgggtgttccgcaagcgggtcggcgtcagtcccagcgacttccgccgccgtaatcaggatgcgcacgacagcctggccgctcagaccgcctggccgctggcgcgaagtgctatctcttagttttttcggggaattccggcttgtcgtcatttggttaatagtcttaaatcaatcaggttatcaactaagagtctggtcaatcaggctctgagaggaatccaaatgagcgataaattacgtgttggtctgatcggctacggttttgccagtaaaacgtttcacgccccgctgattgcggggacgccggacgtcgagctggcagccatttccagtagcgacgccagcaaagtccacgccgactggcccgccgttaaggtagtggccgaccctcaggcgctgctggacgacccgacgctgcaactgatcgttattcctacccccaacgacacgcacttcccgctggcaaaagcagcgctgaacgccggtaaacatgtggtagtcgataagccgttcaccgtgacgttgtcacaggcacgtgaactggatgcgctggcgaaagccaaagggctgctgctgtcggtgttccacaaccgccgctgggacagtgacttcctgacgctgaaatcgctgattgaggccggtacgctgggtgaagtgcgctacttcgaatcgcactttgaccgcttccgtctggaagtgcgtaatcgctggcgtgaaatgaaaggcgcaggcagcggaatctggtatgacctggggccgcatctgctggaccaggcgctgcagctgtttggcccgccggtcgctatcacggttgatctggccgagatgcgtccgggcgcgcagactaccgactacttccacgcgacgctgacttatccgcagcgccgtgtcgtgctgcacgccagcatgctggtagcggcagaatctgcccgttataccgtccacggcacgcgcggcagttacgtcaaatatggtcttgatccgcaggaagatcgcctgaagtcaggtgatttcccgccgcaggaagactggggctatgacatgcgtgatggcactctgacgctggttgacggagattccctgaccgaaacgacccagctgacccagccaggcaactatcccgcttactatgcgggcatccgcgatgcgattgccggacgtggtaacaatccggtgacagcggaagaggcgattcatgtgatggagctgatcgagttaggtctgcaatccgccgagaaacgccagacgatgtcgctgaagcgcgtttaatcggtcggtgcttaaaacgcaataagtaaaaaagccaaacgggccggatatccggcccgttttttgtccctacgcttcaggattactgcacccgtgcgcgaagagccgctttctctgcttcgttaaggaacgcaatcgtcagaccattttcctgcgcctgacggatctgcgccgcgctcagaccggcagccggagcggcgtgatgatactcatgcgccagttcaatgccctgaaccgccggatcatccgtgttgatcgtcgccagaatgccatgctccaggaaggtcttcagcggatgctgcgccagtgatggcacggtgctggtctggatattggaggtcaggcaggattcaataccaatacggtgctccgccaggaaatccatcagcgcgcgatcttcaatcgctttcacgccgtgaccgatacgttctgcacccagctcccgaatcgcctgccagatgctctcgggtccggctgcttcgcccgcatggacggtcacgcggaaaccggcatcgcgcgcctgggtaaagtggctcaggaaactcgctgcccgggaagcccagctcatcacccgccagatcgaccgcggtgatgtgatcgcgatgggcaagcaaaccttccagttcgctgaggcaggcatcttcgccaaaggtacggctcataataccgatcagacgcacgtcgatatcgtgctgctgacggcctgcgcgcacgccctcaattaccgcttcaaccacaccggcaatcggcaggttgtgggtcatcgccatataaccaggggaaaaacgcagttcagcatagtgaatgcccgcgcgggcggcatcttcgacattctcctgcgcgatccggcggcaggcatccagatcacccagcacttttacaccccagtcgagcttctgcaggaagctcaccaggtcaggctcattctggccgacctgcacatgcggacgcagcgtctccagcgtggaagcgggcagggctaggttaaactggcgacctaaatcgagaatggtttgtgcacggatgttgccatcaaggtggcggtgaatatcagtcagaggaattttagaatcgatcatggcgcactcgctcagttgtcggtgaagtgcagagcattataaaaatatcttgcgcaacagcgccagctatttgcgcaacagctgcgccggatgctgcttaattacgcataaccggcgagcaatggttgcctcgtcggttaatgtcagccctgcaactgatggatcgccgcaatcaggcgtgaaacgccctcatcaactttgctgcgcggacagccaacgttaagacgcaaaaaccctttgcctgcatcaccgtaggtcgatccgggcataattgcgacccgttgctggatcagcgcctgttgcagggcctcttctggaatgcccagcggattgatatcgagccaggcgagataggtcgcctcgggaatgtgccagttcagtgcgggaaactcagcgttaagccgattggcaaccagtatgaaattaccataaagatagctgcgcagggcatccagccagggtgcgccttgtcggtaggcggcaacgtgtgccgtgacggccagcacggccggagacgaaaggccgtcagcatttttcagcgcctgaaaccaggcggctctgtctgccgcatccgggataattccccacgcaccggtcaggcccggcacgttgaagcttttcgacgccgaggtaaacagcgcccagtcactgcgcgccacgctggcccacggagtatggggctgattacccataatcatatccatatggatttcatcgctgatcacccgcacgccgtgacgatcgcagagcgccgccatctgttgcagctcagctgctgtccacactttgccggtgggattgtgcgggctgcagagcaacaggattttgcagcgcgggcgcgccagccgcgtctccagcgcggccatatcacatcgccagctaccgttatcccgctgcagcggcatctccagcacctgtcgctgattgccgcgtaccgttttataaaaagcatcgtaggcgggagtgtggagcaccacttcatcatccgggttgctccagcggcgcagcatctgcgccaccatatagatcaccgaggggccataaaccaggctgtcagcatcgggctggtagccgaaacggctggacatccagtggcagcaggcggaaagaaaatcatcatgctgccagcgactgtaacccaacacgccgtgtgctacgcgctgcgccagcgcctgctgaaccgctggcgcagttctgaagtccatatccgaaatggtaaacggaagcagatcggggacgccaaagcggtcagccacgaaatcccactgggtcgaccagctgccgcggcgatcgatgacttcgtcaaagttaaacattatcggctccggcacatcaggcaggtacattcatcaggtgtgacagttcatctttcaccgactgcacctgtggaccgataaccacctgcaggctggtctgattaagatggaccacacctatcgcgccgttggctttcagcgacgcatcatccactttactcatatccgccagggtcagacgcagacgcgtcagacaattatccagcgaggtaatattctccacgccgccaagtgccgccagaatagctggtgagttatagccagatttgcctttaccggcattgctgacctgctgcgcaaccgcactggcactttccacttcgcgtcccggtgttttgatattgaagtgcagaatggcgaatcggaaaatcaggtagtaaccaacaaaccatatcgctgcgacaacgggtacccagtaccatttggtcgacagcccgtgcagcacaccaaacactacaaagtcgatgatattgccgtctgtattgccgatagtgacgcccagtatcgccatgatgctgaagccaacgccggtcagcagggcgtggatcagatagaggaacggggcgacaaacagaaacaggaattcgataggttcggtggtgccgccaaccacgcaggccaccacgccggagatcaacaggcctttaatcttatggcgattctccgggcgggcgcagtgatagatggccagggcagcacctggcaggccacccaggaacgcaggcattttaccctgtgacaggaagcgggtcgcgctttcagcaaaaccgtgggtttccggacaggcgagctgcgcctggaaaatggttaaggcaccgctcacgctcttgccacacacatccagtgtgccgcctgcatcggtaaagcgcatgatggcgaccagaatatgctgcaggccaaacggcagcagcagacgttcgccggttccaaagatcatcgggccgaaatcacccgcgctgtttatcatccagcctaatccggtgataccccgcgcgaaaaaaggccagatcagcgggacgaccagtcccagtaaaccaatcaccagcgtggtgataatcggcacaaaccgggtgccgccaaagaaagccagcgcatcgggcagtcggatgttatgaaagcgctcatgcagacagaacaccacaatacccacaatgaccgcgcccagaatgccggtatcgatcgacggtatccccaggatcggctgaacgttgttagctttcagcagggcggcatcggtggttggcagaatgccgtggatattgagccagaagttgatgctgaggtttagcacggcataccccacaaagccggcaaacgctgccacgcccttgttctcgcgcgccatacccagcggaattgcaatggcgaacatcaccggcagatagctaaaggcgaaagatccgagtttggccatccagagaaacagatattgcagccaggggtgatccagcacaggtaacagggtcaggacatcacgactgctcagcgaactgccaatcccgagcatgatgccgcagaaggaaagcagggcaaccggcagcataaaggttttccccagactctggaaaaattcccagacggacattttttggtgagagggtgacatgaacgctcctggataaacggaccactgagtgaagtggcgggatgataaaacgttttacctggatcttatgcgcgctgaatcacactcttcaggtcatggacgatataattctgacgtcataaggtgtaacgttttaccttgttttctaatgctgtagttcagttgagtaatctgatgagtaaaatcaccatcaatgatgttgcggcggcggcgggcgtgtcggtgaccacggtatcgctggtgttatccggcaaaggacggatctctgcggccaccatggcgcgcgtgaacgaggccattgagcaactcggtttcgtacgtaaccgttcggcaaccatgctgcgcgggggtgagagtggcgtgattggcttgatcgtccgcgatctcagccagccattttatgccgaaatgacggcaggtctgagtgaagcgctggagaagcagggcaaattgctgttcctgacgcagagcggcgcccagggacagcatctgcatcgctgctttgagtcactggtcgctcagggagtggatggcgtggtgctgggaggcggtgccgataaggccagccagattgtgacacgggccagagaggtaaatatggccttagtctgtgccgcgcgcgccagtagcctggaggaggtggacgctattcgccccgataatgctcaggctgcgcgtctggccaccgaatacctgattcgtcaggggcatcagcgcattgcctggctgggcggccatagcgcatcattgacccgggcagagcgtcttggcggctactgcgccaccctgctgcaatatgggctgccgttccggcctgagtggattattgaatgcggtaacacgcaaaaagaggcggctgaagcagcggtacagctgtttcagcatcatccgcggctgactgccgtgctagcctataacgccactaccgcgctgggatgctattttgggctgttgcgcaccgggcgaacgttcgcccggggtgcagtcgacagctattacgatcagcaactggctctgatgggctttggcgatgaaccgcaggcggaactgaccgatccgccgctgacgtttgtcaccagttcagcccgggagattggccgtgtggcagctgagcgtatcctgcaacggatagcgcaacccgatgccgcccggcagaaacgtgattatgccgccgcagctggttattcgcggctcggcataaaaaaggcgacccggaggtcgcctttaaaagaaaagtagagaattactgcggcatcccttcgctggtcggcatacccagcatatagcgggagaggaactgctccagcgtcattttgtcgccgttcatgttcacctgaccgttggtatactgcaggctggtgacgatattgttatcctgctgctgggtcaggcggaacatctgacccatcgccgccagtcctttcacctgctgatctgccagcttctgtgcgtcatcggcctgatatccttcagccagtcccactttatgcatggtttcggtcgccattggcatattgatgaccagcttgctgtccaggctcttgagtacccgatcaaccatggcgctgagtgtctgggcttcgccggtcaccgcagagggatcgttgaaatttgcgttcaggttaaaggtactttcacctttatcatttttccagctcagcggggcgatactgatcgcaggtgagcccttcagcagcatcggcagattgctcatcagaatctgatgcacacccgcctggtagcggataggatcttccgcgacgccaggctggctcagcagttcctgcatctgcgcgttgtaacgatcggagaaggcttttaccgcctgcgcatcaaactgtgacagtttcatcttcagcgctgcctgaccaaaatcctgcttctgcagctgaatgccttcaactttgtagtcgatattgccgccaatcttaccggcgctgttatcgaaagaggaggtgcctttcattttgtgcagcgtcagggcgtcctgaccattgatgctggcattgaccttctcaatatccactgactggtcgccaatgcgcacaccttccgggctgagatgggtgttaccgctcagcttcagaccattaatggtgaacagcactggctggcccatctcatttttactggtcagcgcgaggctatcaacgtcactgtccagcgacactttgtcgcctttgttatccgcgctgacgttgaaggtgcccccattggtggcaagacgctcgccgctttgcgcattctgataatcaaccggcagaacgcgcagcgccgtatcggtggcaccgctgtagccgatacgggtatcggcattaatcagtgacttgttgccggtcagctcaaacagctttttcaccgcatcggtgttagccagttcggtatgaaccgacgccatgctcgggatcagattgaaatgcttcagctgagcaaaggggaaagggccatgatcgatggtttcgttcaggatgatgctctggcctggtttaagcaggggattatcttccgtctgcgagttggcctgaatcaccagattcactttgctgctgaacacgccgcgctgatagtcctgatagctgatcttcagtcggctgttaggggcataagcattcagctgggcattggcgtttctgcaccagctcatccctgtggctttcaatctgcttgccggtgaaccatgccgcgccagtccagactacgcccagtgcgatgatgacacctacggcaacattggtctttttcattgctgattcgtccttatccttgagtccgcttatgccgcaggtttaccccagcgactgaagaaaaacgcccgcaggcgtttaaaagctaataggttgaaataatagcagttaacaggcactccgtcagccgcttcaccctaagtcgttaaatacccgcgccagtcggcccgtgcctgcgaccgttacgggggattcgctggcggcaatgaagcaggattcacctggtttcagcgtcacctgctgctcgcctttggcgatcaccgtctggccttcgatgcagaaaagcagtgcggcgctctgctgcgccagcggctgtggctctgcgttcagggtatgaatggcaaaggcaaaatcctccaccggaatcgggaagcgcagcgcgttgccctgttgctctggctcggtcagcagggtgctggctggcttctcttcaaacttcaggttcgccatcaactcggcaatatcgatatatttcggggttaaaccggcccgcaacacgttatcagagtttgccatcacctccagcgccacgcctttcagataagcgtgcggggtctccgcgtagaggaacatcgcctcgcccggttgcagcgtgattacgttcagcagcaacggcgaaaacaggccgctgtcgtcaggatactctgccgcaatcatgcgaatggtctgccacggctcaccctgttgtgcatcaaccgtggatttcaggatgcccagcgccagcgatttcgcctcaccctccagtgacagcagggtagagaagagcgcggccagcgtatcctgatcgggatgctgcagaaaatgggctatctgtggatgtgcgcccgcaaccggctccagcagtgagaccatctccgtcagggtgcgaaagccattcatcgcctggaagggcgtcagcgcgtagaccagctccggcttgtggttggcatctttataattacgctcagcagccgtcagcggaatacccgccgcattctcacgggcaaagcccacttcggccgcgcgtttgctgggatggacctgaatcgacagcggctgatcggcagacaacactttgaacaggaagggcagttcaccaaaacgctgtgccaccgctttgcccagcatggcggcaggcgcggcatcaatcacgtcacgcagcgaacgctcgctgccctggtcaatcacggtggaggggcttttcggatgtgcgcccatccagagtttccgccatcggcagcccctgtggattggcgattccgtaaagctcagtcaacgcagttttgctgccccatgcgtagttttgcagcgtattgctcattttttgcattgtataaccctttatcacgggaaattattgccagtattaaagcagaaactgccggtaaaaatacatctccagcgcaaaaggacgctaagctctgataatgttaaattattgtgtattactatcctgaccgcccggcagtcgatcgtaatgacgtaccgggcggtcattcttttaaaaaccagatgaaggagacgtattcatggcagccaatcgcattgagaaagattcaatgggccccatcgacgtaccggcagacaaactgtggggcgcgcagacacagcgctcactggagcacttccgcatctcaaccgaaaaaatgccgaccgcgctggtgcatgcactggcattgaccaagcgcgccgcggccagcgttaaccgcgatctgggactgctgcccgctgaccgcgccgaggcgattgtcagcgcggccgatgaggtgctggctgacaagcatgcggatgaattcccgctggcgatctggcagaccggttccggcacccagaccaatatgaacatgaatgaagtgctggcgaaccgcgccagtgaaatcctcggcggcgagcgtggtatggcgcggctggttcatcccaatgatgatgtgaacaagagccagagctccaacgatgttttcccgacagcgatgcacgttgccgccgttatcgccttgcgcgaacagctgatccctcagattcaggtactgaaaaagacgttgagccagaagtccgacgccttcaaagatatcgtcaagattggccgtactcacctgcaggatgccacgccgctgaccctgggccaggagatttccggctgggtggcgatgctggagcataacctgaagcatattgagcagagcattccgcacgtggcggaactggcgctgggcggcaccgcagtaggcaccggcctgaacacccatccggaatatgcggtgcgcgtggcgaaggcgctggccgatctcacgcagcagccgtttgtcactgcgccaaacaagtttgaggcgctggcaacctgtgatgcgctggtgcatgcgcatggcgcgctgaaagggctggccgcctcgctgatgaaaatcgcgaacgacgtgcgctggctctcttccggcccgcgctgcggcatcggcgaaatcgccatcccggaaaatgaaccaggcagctccatcatgccgggtaaagttaacccgacccagtgcgaagcgatgaccatgctctgctgtcaggtgatgggtaacgatgtggcgatcaacatgggcggcgcatccggtaactttgagcttaacgtgttccgtccgatggtaatccataacttcctgcaatcgattcgcctgctggcggatggcatggacagctttaatcatcactgcgcggtcggcattgagccggtgcgtgagcgcatcgatcaactgcttaacgaatcgctgatgctggtgacggcgctgaatacccatattggttatgacaaagcggcagaaattgccaagaaggcgcacaaagaggggctgacgctgaaaggctcggcgctgaagctgggttatcttaccgaagaggagtttgatgcctgggtacggccggaagagatggtcggcagcatgaaatcgtaaggtttgagtgagtcagaggccagcgaatgctggccttttttatttatatcggacaatcgacccacagatgcagtctggggattaaaagattcagcggttcagcggcaggtttataacgatggttaatattatcggcatcgtagttaagcaattcacccagaaaccggaacctggctgcgatcgcgacagataaccagaatcggtgaaggacaggcgagctgagtctgtttttgttcatccgcgcgccagacgcgtgcaaccggctggactttcaccgggcgcttgattttcagccgtgccgaggcgggcagggcgcgcacgcttgccagctcctcctgcactttttccgcccactgttcacgtgaccacggcgcttttgcacgtcccgacttcaggcttttttccagctgggcgatcacctcttcacgcttgagattcttgataatgtgcttgttggcccagccgaaacgcaggctatccggtgcgctcagcagggtgatagtgcgataggcattcagggtgatcagcccgcgcaaatgctggtggacaaactcaaaacgcgcctcactcggcaggccagagtccaccgtaatcagctgctccagccgtgctttcagctgattgatgacgtcgaccagtgcgccgatctccgcctcctgctgcgcgtcgcattcgatacagagcgcgccaggtaagcgcacggcagccttggtgctcagctgttctgactgatgctgcataaacaggcggcagtagtggtcaagcgccatctttaacgcgctctccccgagatgctgctcgacggcaatccgggtgatcgcttcatgttcgcgacctttaaccaccggcggcaggctgaagacgcgggcgatcagcagaggctgcgcttcaatctgctgacgcaattcacccagcgccagttccaggtcatttacacattgatgcatatcagccactaagtcgtagcgcgtcatgttgtgcctccatagttacaacgtccacaatgtggcagaagcctggcgaggatgcaagtgtcatatagttacaacatactataagtggtttactcaaaaccgtgcggcctgcatggctatccagtcaaaagggcatcacgcattttggcttatcgcagaacatgttataaaaacggttcgcctgctaaccaggagattgcctgtgaatcagaacaacaaacccggcatcgccgccattattaccctgggctgggtgcagatcctgtcatggggcgggtcgttctatctgatggcggtgatggcgaatccgattgcggctgagacaggctggtcacagcagtggatttatggcgcgctctcgaccgggattctggtatcgggcctgctgtcaccgctggcaggcaggattatcgcccgcaccggtggccgcctgttgctggcactgagtggcatggtgatggcggtggggctggtgatcatggcttatagccactctctgccgctgtttctgtttgcctgggtaattattggcatcggtatggcgatgggcctttatgacgcactgtttgccacactcggcacctgctatggcggtcaggcgcgtgcagcgatcaccggtatcaccctgatatctggcttctgcaccacgctggtctggccgggaaacggcgttgttaatccacggattcggctggcgaaacgcgtcgctgataattgcggcactgatggtcgtctgcgtgctgcccgcctatctgtttgccttacccgacagtcatgctaagcggccggtgaaacgactgagtccgcagcctggcacggcggagattgcgcctgcgctgttctggctactgtgtgccatctttaccctggcgtccgtgatcatgacggctatttccgtgcagcttatcgctttgttacaggcgagtggccatacgctgacctcggcgctggcgatcagcgccgtacttggtccgtgccaggtgggatcccgcctcgtcgatatcgcctttaaacgcagtcatcccatccgtaccacctttttttccgtcgggctggtggcactgggcttgctgttgctggcactgtttccgcagatggcattgctgagcatggtgttgtatggcgcaggaaatggcttacgtgccatcgtgcggggaactttaccgctggcgatggtcaaaccagagtcctatgcgattgtggtgggtaaaatggcccgcccggcgttgatggggcaggcactgacgccgctgataggtggatatgtgtttgaaaagatgggtgcatcggcgacgctgtggttgctttgcgccctggcaatctttaacgtggtactggttatggcgctgaagcagcgattgccggcgacatcggccaccacggcataacggaacggttctccttgctccgcaggaagagggccgttagcaggctaagcaccttgtgctatcgggcctcagcctttggtgaatacgtgccttgtcaccgccggtttgcttcaaaaaagcaacagtgtttgttatatttattgctcattgattgttcacttatgcggcaataaaacaataagatgcaccgcaactcaggataaagaaatgcttgattaccgcttcccgacagctttgcaaatggttctgagcgtagcgatggcggagcaaatgggaaaacgctctaccagcgcgattctggcctacgggctggaagcgaatcccagtttcatacgaaaattaatggtcccgctgacccgtgacggcattatcgtctccacgctgggccgtaccggttcgattcatctgggccgtcctgctgcagaaattactctgcgggatatctatgtctcagtgatcgaagacaaaaaaatctgggccgcgcgtcctgacgtcgcgccgcgctgtctggtcagtgccaacctctgctggtacttcaagtcgatagccgatgaagccgagcaggcgtcgctggatgtgctggcaaaacgcaccgtggcagacgcactgaacgaactgaagaaacgcgacaccagcaactgcaccgccgtgccggaacctgaacccgaagagattgatgatctctgcaaaaagagccgctgattagcggctttttttatgcctgctgaacatccatttctgagccacttctttcccaaacctgcaacgcaggccttctctccgtaaattccatcttgacctcttaccgtatcgtaataaaatgacttcactggatgaagtcgcggaggtcaggatgaacaccgttgtcagggagttacggaaaaaacatcgtgaaacgttggagcaggtttttcaaatgccgccgccgtccggactgaaatggcaggcagttgagtcattaatcagggctctgggtggtgagattaaagaaggcagtggttcacgggtgcgatttcttctcagaggaagaatagcgcgttttcaccggccgcatccttcgccagacaccgacagaggggctgttattaatctgcgtgaatggctggaaagtattggagtcgatccctatgaataatcgttcaaattcatcaatcaccgtcgctggtcaacccgctgtgatcacctatgttcctgaactcaacatgttccgtgggcgttttactggcctgtcaggctactgtgattttgtctctgacagcgtacaggggctgtacaaagagggcgagatttcgttgcgcgaatacctggaagattgtgcagcctccggcattaatccctatgctgagcaggaaaaaattaagacctttacgctgcgctatcctgaatcgctgggagagcgcctgtctcaggctgccgcgcaaaatgaaacctcgctgaatgcgtttatcattgaaacgctgaatgaaagattgaagcggcgctagcctgcaaggcggggtctgctgaaatcagtgaatcacaggcaaaaaaaggggcgatagcatggtcgccccttttaacttttacggtttacgccgtcacggacgatgcactacctgaccggcgcgtcaccagcttgcgcagggccacatagaacaccggcgtcaggaaacaggccgaacagcgtcacgccgagcatgccggagaagaccgtaataccggtaacgccgcgcacctctgcacccgcgccttcacccagaatcaacggtattgtaccggcgataaaggcgatggaggtcattacaatcggacgaagacgcaggcgacacgcttccagcgccgcttccacaatccctttgccctgaatctccagctcccgcgcaaactcgacgatcagaatcgcgttcttacaggccagccccatcagcacgaccagtccgacctgcacgaagacgttgttgtcaccgccagtcagccagacgccaaacagcgcagagagcatggtcatcggcacaatcaggatcaccgccagcggcagcgtccagctctcatacagcgcggccagcaccaggaacgccagcaacacggccatcgggaagacaatcagcgcggtattgccctgcgttgactgctgataactcagatcggtccactcgatgttcatgccgtttggcaatagctgaccggacatcgcttcgagctgactcatcgcctgcgccgaggagagcacgcgtgggtcggcatcaccaatcaaatccgccgccggatagccgttatagcggatcaccgggtcgggaccgtaggtggtggtaatgttgaccatgctgccaatcggcaccatctcaccgcgatcgtttcgggttcgcaggttagcgatatcttcgatgctgtcgcggaaatccccgtcagcctgcgccatcacccgccaggtgcggccaaagcggttaaagtcattcacatacgacgagccaagataggtctggagcgtgctgaacagcgcggtcagcgatactccctgcgctttggctttatcccggtctaccttcacatcaagctgcggaacgttggcctgataagaggagatggggaagtgcatccctggcgtctgcatgatgctgcccgaaagcgtattaatcgccgtctgcagtgcgccataacccagacccgcgcggtcctgcacatagagcgaatagcccgagccctggcccagccccagaatcggcggtggcataatcgagaagccaaagccctgctggatttgagcgatcttcgcattgatctcagcgttgatctccgccgccgtatgtttgcgctcattaaacggcttcagaccgaagaacaccgtgccgctgttcggcgtattggtgaactgcaatgcattcaggccagggaaacgcgaccgcataggcgacgccttcggtctgcataccgatttcgctcatcttacgaatcacttcatccgtgcgcgccagagaggaaccttccggcatcttcacgccaccaatcaggtagagcttatcctgcgtcggaataaatccacccggcacggtgtggaacataaatccggcacccgccagcagcagaatatagacgccaaacacggcgccacggcgacgcagcgtacggcccaccagcgattcataaccatgggcactgcgctggaagaagcggttaaacggccggaacagccagccaaacagcgcatcaatgatccgcgtcagccggtctttcggcgcgtgatgatctttcagcagcatcgccgccagcgcaggcgagagcgtcagcgagttaatggcagagatcactgtagagatggcgatggtagtggcgaactgcttgtagaactgcccggtgacgccagagagaaacgccatcggcacaaacaccgcgcacagcaccagcgcaatggcgatgatcggcccggagacctcacgcatcgcctgatgcgcagcggcgcgtggcgacagccccatctcaatgttacgttcgacgttctccaccaccacaatggcgtcatccaccacgataccaatcgccagcaccagcccgaacaggctcagcgtattcagcgagaagccaagcagatagagcacgctaaaggtaccgactatcgaaaccggcaccgccagcaggggaatgattgaggcgcgccaggtctgcaggaacagaatcaccaccagcacgaccagaatgaccgcttccagcagggtctgcaccacggctttaatcgagtcgcggacaaataccgtcggatcgtaaggcgcggcccatttcacgtcattggggaagcgggtcgccagctcatccattttggcgcgaaccgcattggagaggtcgatggcgttggcgccaggtgcctggaagataccgataccaaccgcatctttgttattcagctgcgagcgcagggcatagctgcccgagcccatctcaatccgcgccacatcgcgcagccgcaccagcgaaccatcttccgaggttttcaggatgatatcgccaaactgctgctcgctctccagtcgtccctgggtgttgattgacagcagaaaatcgctctgttttttcagcggctcggcacccagctgaccggcagagacctgcacgttctgctcctgcatcgccgttaccacgtcagaggcggtcagaccacgcgccgccactttattaggatcaagccagacgcgcatcgcatactcgcctgcgccgaaaatctgaatctgaccgacacccggcagccgggcgagctcatctttcaccttgagggtggcgtagttacgcaggtagagcgaatcgtaggtattgttcggtgagaacatgtggacgaccagcgtcagggtcggcgacatcttctgggtggtgatccccagccgacgaacatcttccggcagacgggcttccgcctgcgctacgcggttctgcacctgtacctgcgcctgatcaggatcggtgcctggacggaaggtgacggtggtcaccagcacgccgtcagaaccggctactgacttcatgtacatcatgttttcgacgccgttgattgcctcttccagcggcgtcgccacggaatccgcaatcactttcgggttagcgcctggatactcggcgcgcacctgtacgctgggtggcaccacgtcgggatattcactgactggcagcagcgggatggcaatcaccccggtcacaaaaatcaggatcgacagcaccgcagcaaaaatgggccggtcgataaaaaagcgggaaaagtccatagcggcctcgggttattgagcgactgccgcacgcatggcgaccggctgagcagtgaccggcatgccgggcataaatactttttgcagaccggcgatgatgaccttgtcgccggattgcagacccgatttaacgatgcgcaaaccatccaccatcgcgccaggctggatatcgcgccgctgcgctttaccttcgccatccaccacgtagacatatttgcgatcctggtcggtcaataccgctttatcatcgatcagcaccgcctcgaactgcgcgctgccgggcagacgcacgcgggcaaacaggccaggcgtaaactgccgctgttgattgtcgagcagggcgcgcatacgaatggtgccggtgctggcggtcagctggttatccagaaagtcaattttgccctggtgcgggaaaccctgttcgccgaccagcgcaatctcaaccggcagcgcatggcgctgctggccctgacgcgccatcgcctgatagttcaggaaggtgttctcatcgacatcgaaatagacatacatctgctgctgcgacaccagcgtggttaacacactggcgctgtcgccggcggtcaccaggttaccggcggtgatcatcgcccggctggcgcggccatcaatcggcgcggtgacgcgggtgaagtcgaggttcagctgcgccatatcgaccgcggcctctgcggccagcacatccgcctgcgcctgactggcggcagaaacgacgctgctcccacgcttcgcgggaaatcgcctgcgtgccgatcagcttctcgctgcggcccgattcgctgcgggccagactcgcctgactgcgcgcccgggccagttccgctttggcctgctccagcgccgcgcggtaactccggtcatcaatggtaaacagtacctgaccttttctgacctcatcgccttcacgatagttaacggcatcaatgtagccagagacgcgcggacgcaactgcacgctctgcaccgcttcaacccggccattgaaattatcccactgactgaccggtttgatcagcacgggggcggcactcacttcaggcggcgggggagcggcgttttgcgccacacccttatcgcagccgctcagttgcgtgatgagcagtaccatccctaagagggttaaaccctgacgaacccggttcgtaatcattgttgttattccgcgatagatataaacaggcggcctgcaggccaatatttgcaacttttaagattgcaattaatcgcggtgagtgtaggcttgcgtggctggcaactgcaagaataacagatacactttatgtgcggtttagggcaggccgatgaaagcctgaacaacttagctaaaaccccacaaatagtgcggcatttaatgtactaataaaacttgcattaaatggcatagtcagccacccttaagtgtaactgcaactgatactaatacttttcgccacggcgacaggagagactggaatgatgagtgatgcttttattcacgatttaatcgactggattgataacaacatcgaagcacgtctggatctggataccgtttcagagcgcgcgggctactccaaatggcacctgcagcgcatgtttaaagagcacaccggttatccactgggtgaatacatccgggttaagaagctgaagaaatcagccgaccgcctgaccagcactgatgaaccgattctcaatgtggctatctcgttaggtttcgactcccagcaatcctttaaccgcagcttcaaacgccagtatggcgtcgcgccgggtgcatggcgtcggcacagcggggattcgcacgcagcataacctcgccagggccagcttgtctggcccgcgcttttctctgcgcgcaaaactggtatcatctgcgtcctgtcgtcacggatgccatcatgtcaaaaaaactctggattggactttttctcgtcctcgcggcctgtttctacggccttaaaccctatctgaattccgtttcagcccctgcccaggccgatatcgccaccctgactgacgcccataccgtggcgcgctgggtgctgcagcatcagcaactgccggactactacctcaccaaaaacgacgcgcgcaagcgtggctggaatccggccaaaggcaacctgtgtgacgtgttgccaggcagagccattggcggcgatcgctttacgaaccgtgaaaagcgtctgcccgcgcgtgcgggccgtcagtggtatgaagcggatgtgaattatcgctgcgggcatcgcgacgccgatcgcctggtttactcctctgacgggctggtgtttctctccaccgatcactaccgcagtttcaggcaggtgccctgatcatgcttaatctgacctttgacctgcgtcagctcaccacgcgcgcggcgttttatcagcagtttgctgagcagagcggctgtccgcagaccttcggacataatctggatgcgttatgggactggctgacgggcgggatggcgctgcctgcgacaatgtggttgcagcactatgccgcgcatcaggccgatttagcgccggtgctggcgctgctggaagaggcggcgcagtcgctggagggcgaactgcgcctgatcattgattaagcgcgtagcggcttgagcagcgcaaccagcgcttcgcgtgctgccagtggcagatcgccgccgccagtgtaaccattgttctcaatgatgacctggttcagccccaccagccagtcgtagatatagtaggccgtgtggttggccggggcggcagagagtctggtcagacgctgaccggaactgaagctgacgctgggagccggaggccgcgagaaaatcacctgaccccggttaacgcggctggcagggcgttcattttcaggacgctgtaaaaagccgagccaggccacaaaatcccccagcaccgtcattgcccgcgtcacctgacgatccgcgcgtgattcatggctgacgctctgcgtatcgggctcatgcagcgcctgctgcagcttttgcgcgatatcggtgcggaatccggccgtgatcagctcttcaaccagccactccatcgttggcttatccacgttcagcaacgccagcaggctgcggttttccggcagctgacgcagatgatccagccacagcagcagcacctgacgcggatactgctgcgcgctctgcagactctgacgcggctgaaccggcgcttcagccgggctctcactgaacaggtcaaattcaaacccgatgccaaactgattttccggggcctgaatactggccggtttgctgccttgtaaggcggactgattgagccacagctgacgcagcgcctcacgcggcggctgcaggcgttccagcagctcgccatgcaggccggtccgatgctgtaaacacttcagtagcgtatcggcgatattctgtttgcgtgccgcctgttccgggctggcacccgcttcggtccagggcaataaacgccgctccaccacagtgtgctgaatctgcgccagctgagccagcagcatgtcgcggcgcgcttccggctgcatctcatcctgcaaccagctcgccatgcggtcgacgcccgcccgatccagtgccagcatcgatccccagtgctgaccgggctgtcccatctgacgctgcaccgcttcatccacattgacctgctgatggcgggcatcgaaaggggtaatcgcccagatcagacgcggtttctctgcggattcctgtgcgggctgctgacgctgccattcgcgcagcgtttcgctggcgaggtcggcatcctgacgctggctggctgcggtacagaccagcagcagatcaattgcctgacgcgcggcgtaaaaaacgggcagcagggcacgtttctgttccagcagttgggcacgcagtggatcctgctgctgcaggcgctgacgatcttcctgggttgccgcgtcaccggactggcctggcgcgggcagttccagcatatcagcatcatcatagagcgcggtttcgcggtgtggaactcagcgggaccagcacttccagcgtcagcagcgccagtaatcccagtggcacgttctgcgccttaccgatgcggttaccattcagcgggcagacttccaccagctgctgttgatcctgctcactggccggcacaatcagctgctcggccggcagcagtgatgtgtcggtcagcaggctcagtggagcaagcacccggctgctgttacgcagctggtgacgcagatgcagcagggtgcgcagcatctcattcagttcaggctgacccggccacagcagtgaaaaaagctgtacccggtcgtcaacgctgagccagggcgccagctcaaccgcctgcggccagaaatgacgatcaagccgcgcatcgtggtgcgcacggcgacggcaccaggaccagagtgttaccagcgcatcgccttccagacccgccagcggcgtggcgagacgatgacgctgcaggcgctgcagtgcgctgtcgatctgtgcggtatcgggcgttgtcgcgccggcacaggcgaccatcagccgtacgatctccgcttcactcagcagcgtcagttcaaccggccactcgtttgagagcggctcgcgctgatggctgaaacgggtggcggtagcaaaatcgaggttgccgggattgatatgctgaaaccagttcagcagtttatcacccatgcgggtcactaactggccctgtgcatcggccaccatttcgttcagcagccaggccttacccgcctgcgactggccaaacagcgccagcgtcaccggacgcgccacctgctgcgccagcgcctgagtctgcacgcgcgcctggcgcagttgcagcgtcagggtttctgcttccagcgccagacgcggcgactgctcacggctgctctcaatccaggccagactgttattcagggcgtcctgcaacaggccaagacgttttgccagcgtttgcggctgacggggtttcagggctttcatcgtttacacacgctcccgctgtcaatccagtattgcgcattggcattgccggtcgccgacagggtattcagcttaagactcaactgctccagcggcacgcgggtgccatcatccagacgggcatcgctcagcaccagactttccgggccggacgcgtcgggtccggcttttaccgccagccggatgcgcagcacgctctcaccggccactttacgcgccagggtggcgtcgttcagcgtcaggctatagagcggcgaggcgggccagcgatcgttatcaagctggcggaagccgagacagacgttgccgcgaatacggaaactgcgctttttatccagcacatagccgggatcgtcgaggtcaatttcgctgtagcagaggttctcgtccgtcagcgcctggttttcgtcgagcatgccaagatagcgaatcgtcgagtagggttcaaaatcgcctgcgcggaaccagaagctgctgaggcgcagatccagcgccagcaggcagagcatcgcaccgaccgccgcggtcgattttggattgtcgatgcggccatgtttgttaaacggataccagtcgctggtgtgatagccttccagcgacaaaatacggctgcccggcagcggttgcagatgacgcaccagcgcctgaatgcccgggaagcgcgacgggcgaccggtcagcagcagcacgtcacactgatagagcgacaccacttcacacattgaacgcagcgccgggataatcgccatccggtgctgcataaattcaccgtgcagctgtgacaggctcaccaccagcggtacctgcagcaggtcaaagcggctgttaccgcccagctcgcgctgaatctcgccgttgacgaaggccagtaccgcttcgcccggcggctgatcgaccagctcgccaaacagtgcgttgatctccgcgtggctctccagcggatcccagttttcgtagcgttccagtaccgcctgcgccagcggaataaacagttgtaaggtgatctgctgacgcagcgtggcctgaccgtccatgcggctgtcgtgaccaaacagcttgttcatcagcggttccgccagcgtcaggcccgctttctgcagatgctgctgcagcgccggtaaaatccacagctgaatcacgtccagcaggatatcgtcgcccgcgactttaaagccttcgcggaacagcagtcgcggcgtgattttgacgttgttgccctgaccatcatccagacgatactgggtgatggcgaggtcagtagtgccgccgccgatatcaatcgaggcgatgcgcaggctcttgcctggcagttcgtcagcatcgcgcgggcgatccggacgggccatgctgctgaaaaagtcttcggcgcgaccggcaaagttgacctgggtttcattaaacagccagaccatctgaccacaggtcgcttcatcccactccatctgcacatccggcagcggtttcgggttctgacgtggcagtgatggtgaaaggtcatcttcgtcagccagccagccttccgctttccagaccagcgccagcgcttcctgcatccggcggcggaaaatttcacgctccggcttcggcatcgctgacggcagcgtcaggatcacatggcgcagctgacgcggcgcgtggctctgtggcatccgctgacgctgtgccgcgctgttcatctgcatcagcgcctgagccagcagctcacacagcataaaggtcatcagcgaactgcggctgtagtgcggagaaaagaccggcagacgatcgtccggtgccagcgtcgagagcggctggccttcgtcgttgagcagggtggtaaagggtgcggcataggccagcggttcagcttgctcgccgggcgtgttaaaacgccagcctggctgatagcgcgcctcatcccacagataacggcgcgggctggagaggccggtgctgccttccagtcccacacgctgcagtgccagacggctcgcttcacgcccgacgcgcgtcaaagaaggccacataaaggcctgctcacgaccgctctccagcgagaaattcgctttgccaaaacgggtctcggcaaactccagacgactgtcaaacagctcgttgtaaacctgatgcggctgcgacagatcgcgcagctgcagctcataggtctgtttcaggccgttgctctcttccgggtgatcttcaaccagaatgccgcaggtatgggagttaccgacatccagaatgatatcgacattgaccgccggggtctgcagcgtggcagcctgaatatggatctcgctgaggtcgagctgttcgcccagcagctccagcagattgaggtagtgcgcctgatactcaaactcgcgcagcgcctgattaatcgcctgttcgcggcgatcggagacgcggtcggtaaaggattcgcgcagccagccgtcaacccaggtcaggtcaagaaaatcacccagctcgtagttgtgccaggcgagcgcaaaggtcacaccgttctgagcatcagccgtgctgaggccgagctgttcaccgccatcctgttccgctacgcagcgggtatcaaaggccaggctgacgcgatgggtattgcccgctgcatcgggcgcgggcagcgcaaccagacgcatccgcgcccagttttcaggaccgccgataaaacgacgtccgctggcgcagcgcagcatcggcagcggcagccagcaggctgacagcagggacagtgagtccgccagcgcgatatcagactccgggcgcaccacttccgcagcgccgccatcttccggatagagcaggaacttaccgctgttgccatcgacgttcaggcgcagcagcgggccgttggcggtctggcgcacaaactggcggcgcgcaggggtatctgagagttgcaggccgaaatccagaaactgcacgccgctattttcaatcagcgaaattttttgtttgtcatcgatcaggggagccagcatcgttatttactctcacgcttaatcgtcatcgggaagacccggtcatcagcatactgcgcttcacatactgcggcgccgatactcgcatggcagaccagcagtggcatacggtagcgcgaactgttctggcacttcgccgtgtagcggctctcaatcaccagattaccggcgctggtcatggccgcgctgacatccgctttacaggtggtattgccctgggcgatctgcacgctgcctttgccgtttttaaactggaagcgcatcaccggaggcttaccggttggcgtcggcatctggtcgatagtgacacgccagcggccatcaatcacccgtacctggccatcgcgcaccgcatccggcgtcacgatcaggtcatcgggtttggccggaaccggcgccgtcaccgttgtggcaagagtagcagatgcgtctgccggtacggtatcggtggtggtgttggccggtttctgcggctgcgattcagggagtttttccggtgctgcctgctcggcaggtggcgtgacagacggtgtcgccgccaccggtgccggagtcgcagcaggagccggagtggataccgtcgccggggctgacgctggcttcgcagtggcaaccggtgtttttacgggttcagaacgatgcagcaacacggccaccgtcacggcggctgcaatcgccaccggcggtaacagataccagacgcggaaacggcggcgagccgctacaggcgtcgccggctgagcttcaacgggtgccgcaaccggcagcggttcagccacaggttcaggttcaggttcgggctcagcgatcatcactggttcagcgatgaccggcgcggcaggcagctcaggcagcggttcaaccagcgccaccggcaggttctcttccagcgtgtcacgcaggcaggccagcgcgtcatcgcggctacgcgcctgggcatcgacaaagccccagaaggtgatgaccggtttgccatcaaccagatagacatactgctggtcggggaattgcagggttttgctcagcagcgcaccaaacagccgcatcgatgggttctctgccgcgcgcgcgcgcgtactgagatcctgcatatcctgctgacaggcggtgagctgttgcagcgccgcgcgacgttcatgatcgctggcacccagccaggatttgacccggccgctaaaaggggcataccagtcgaggcgatcgccccgttcattggcctgaggaatggccaggcaatctgccagtgcgctctgacggcgcaggcgcagggtttcacgaatttgcaatgctgaggcgtagaccggctggccattttcacctaacgccagaactgcatctaaattaccgctgcgcagaaaagtttttgccacctgttgggcccttatcggtcgttgtctgaggcagaaaatcgcgtgttatcgacgattaggttgattttacgcggggcaaggacaaatcaaacggcagaaaagggggtaaatccactgtttttttcaccggctgacggaaaaaccaccgctatttcagagagtatgacgcaatcagccggatttgcgcaccagcagcaggtgggcgatgacgccgcccgccagtccccagaaggccggaccaatgcccagcagcgaaacgccggatgcggtgatcagaaaggtgatcagcgcgctgtcgcgttcggcaggcagatccagtgcgcggtggaggctgccacccagcgtggcaaggagtgccagacccgccagcgcctcaatcagcaccacaggcagggcactgaacagcacggcgatcagcgcaccggacgcgcccgccagcagatagaagatccccgccagcgccgccgcacgccagcgttgctgaggatttgggtcgacctcatcgctcatgcagatggccgccgtaatcgccgccacgcagaccgaaaacccccctaatggcgacagcagcagcgcaattaatccggtccagctcatcagtgaagagacgggtggacggtagccgtgcgcctgcagcgtggcgatgccgggggcgtttctgtgacgccatcgtcaccaggaaatagggcacgccgatccccagcagcgtggtgagggtaaagtgcggcatcacgacttccggcattgtcagcctaatcggctgcggcggaaagtggatggcgtgctgtgccagcgcgacggcaacacccaccagcagcgtgaccagaattgcatagcgggccagccagcggcgggccagcagccaggccaggcacatgctgccgcacagtacaaagttactttgcaaatcggcaaaggtctgcagcccgaagcgcagcagaatacctgccagcatcgccgctgccagcgaggcaggaatgtagttcatcagccgggcaaacaggccggtgacgccgcacaatacgatcagcaggttggcgaaaacaaagacgcctgccgcctcattcagcgaaatgccgtgaaaactggtcgtcagcagcgcagcgccgggcgttgaccaggcagccagcaccggcatgcggtagcgcagtgacaggctcagcgaagcgatcccctgcgcaatgcccagcaccgacagccagccgccaatctgcgcgggcgtggcgcccgccgcctgaaacatctgatagataatcgcgccactgctgctgtagcccaccagcacagccacgaagccggaaaccagcatcggcagggtaaaacggggaggttccgctctcgtcatggtcagactctttatgagattgtgcgttatagcgcacatggtcgcatgatgcgctataacgcacaagtgttacactattgccataacgtcactcaccaggatgacgagaaagcaggagaaaaaatggcggattttcagcaacacctgagcagcgcgctcagacagttgcggcaggccaatggctggagcctgacgctgacggcggagcgaaccggcgtcagtaaagcgatgctgggccagattgagcgcggcgaatcgagtcccaccgtggcgacgctgtggaagattgccaccggtttcaacgttcccttttccttttttatcgacagcagcgtgttgccttcaggcgccgcgcctgcattcagtcagcccaatgccgacatgtcggtacggtcgctgctgccttacgatccgcaactgcgttttgatctgctggcggtggagctggcagcgggcgcgcagagtcattcttcgccccatgaagcgggctgtgtggagcaggtggtgatcatcgagggcgaactattgctgggcgtcggggatctctggcgacgtctgctcgccggggaggcgttccagttcagggccgatgtgctgcacagctaccgtaacccgctcagcacgccgctgcgcttccacagtctgatccactatctgcagcgcccggaggttacaaattgatacctgagcaaactacacagtttaccttcgtatctttatactttcgcttatcgatggagacgggtaatgagcgatctgactgaatccgctgcaatgctgcgcatgctggtgggcaagctgggccgccggttgcgcgagtcagcaccgcctggcgaattaacctggtcgcaggtcgcggtgctgggtcatctggttcgcgatggggcgatgacggtaacgcaactggcggcggccgagggcgtacgcacccagtcaatgggcgcgaccgtcgccgggttactggcggcggaactggtgacgggcgagccggatccccatgatggccgtaaaacccgctatcttcccacgacgtccagcctggcggtgattacgtcgagtcgcgcgatgcgcgatgactggctggtccggacgctggaagcgcgactgagtccggcagaacagcagcaactgaccgacgttctccctctgctgcaacgactcactgactattaaatctgaggattcaacatggctgtaaccacacttgatgcaaaaactgcgctgattgttatcgacctgcaacatggcattgtggcgctgccgctggttcatgaaccgcagccggtgatcgaacgctgtgccggactggctgaggcgtttcgcgcgcacgatctgccggttgtgctggttaacgtggctggtggggcgccgggccgcaatgagcaggcacgtcacagcggcgaattgcccgccgactgggccacgctggttccggcgatgaccccacagcagaatgaccttacggtcaccaagaaaacctggggtgcgtttcacgccacggcgttgcacgatgagctgcaaaagcgcggcattactcaggtagtgatttgtggtatcgcgaccagcatcggcgtggaatccaccgcacgacaggcgtatgagctgggttacaacgtcacgctggcgaccgatgcgatgaccgatctcaacctggatacgcacaacaatagcgtgaacctgatcttcccgcgcctgggtgaaaccggcagctgtgaggatattaaggcgcagctgaattcgcgcgcatgattggcgtgtgacgttaagcgtcgggccaccgcgacggtggcccgttgagggcagccacagctcttatcaaaaaactgcgccacgtttctccccagggggccggacgaaactcttcaccagcaatcgctgacataatgacattcaaatcatcatcctcattctgaagcaggatgtttatttcattccgcgcttcgataacaggcatgtcatgatcaatatagctctgaagcatttcttcgagggtattgccaaagtcgtcatggtggcagcttaaaaacactcttaacatgccggttagcgccgggtattgtttctcgggtttatcaccccatccacggataagacgtgagaacatagtaaggtttcccgttataatttaccggaaggcgtaacccagcgttaaaccgacgctgtaattgcggcccggcgcggattcgaagtagcgtccattactctcattcacaatcactgaacccacatagtgccggtcaaacaggttatcgacccggccaaacagatccagtgtccagttctcaaccagccacttatagccactgttaaccgctgcaacggtgtaggacggggtgttcacgctattctgatcttcagcggcgatctggctcagataacgtacctcactgcctgcataaaagccctgttccggcagataaccgagtccggcgtaagccatgttacgggcaataccaggaatgcggttgccgtcacagctgtcgctgccgcaggcgttagtgcgatagcgcgcatccagcagggtgtaggccatcttcagccgccagtcccaggcaaactgctgatccaggcttaactccagaccgcgacggcgggtctgaccggcatttttataggtagtgcgtccgccactgctggcatccgccacaatctcatcctgggtatcggtctggaacaacgccgcgctgatcaggccattgccgatgcgtttcttgctgccaatctccagcgtatcgctggtggccggtttcagccccagattcagaccggtcgcgccgtctgaacggtaagagagctcattaatggtcggggtttcaaagccgcgaccggcggagatccacgcgttccagcctaggtcaaaggcatacttcagtgccgcagcgggcagccatttgtgatagcgcgcatcaccgctgtcgtcgccgttaccgggctgaatatagaagtcatcagagtcaaagttaacggtgctgaaccgcacacccgcatccagcgacagcttatcggtcagttgccaggcggtctgcagatagggatcgagcgtccacatcaggttgcgctcgttgcggcgaagattgccctgttcgcccagttgcgtcaccccgttgctgaccgtgaagttttcatagcccttgcggcgctcggtcatggtttcgtagtcgagtccgccggtcagcgccaccggaatcgacagcagcgtgtcgcgatgggtccagcgggtatcgacgccctgatagtggcgggtcagggcgatcacgccaccgggatgagacgggttgcgctgcacggctgcagggatcgactggaactgggtagtttcgcgcatgcccgcatagagcatcacgctgaggtcgtcatgttcactcatctggcgctgataacgcaggccgccctgagtctgatcgacagtcttacgggtgttataaagcgggacgttgctaaccacctgacgtggattgtcacgccactgcgcctcggttaagccgccgggatcctgcgcgtcaatgtgaacgctgttaaacagcagcgtcagggtgctgacatcatcagtacgcacgcccagtcgggcgttgccaaggtttttctgcgcagcactgtgatcacgatagccgtgagtggtgaagcgtgaggcggagacggtgtagttcacatccccggcatggctgccgtcaccggtcgcgccgctggctttgacgctgtttcgccagctgccgtagctgccgtaccagctgctggcttcaagcgtggtcggctgctgcccctgctgagtggtgacattgatcacgccacccgaagcgttgccatacagcgcagaaaacgggccgcgcagcacctcgacatgatcaatcgagccgatatcgatatttgaggtctgcgcctgaccatccggcatggtggccgggatgccatccacatagatgcgcagcccgcgtacgccgtaggttgagcgggagccgaagccacgcatcgacagctgcaggtcctgtgcgtaattttgcctgttctggatctgcagacccggcacgctgctgaggttttccgacaggttaacgcgcggcgctgcctggcgcatatcgtcgccactgaccacgctcagggccgcaggcgtatcgagttcgttaaggcccgtttccggcggtgccgccgtgacgaccagggtattttcattatccgccgccagcagcggcagtggcaaaatggcaggcaacatcaacagcgtcgcctggcgcagagagattattttcattatatgtggcctgaaaaaagagaggatatgaaccagatggaacaatttccgcatatggtaagggtttgatgcgctggggtacatcgtttcgggctggattttttctctgtttaccgccaggctggaatccatcttttgcagtgatatggcgtccgattcacccggatgcagacaaaaaaactcacgggagtcagcatgaaacaacctgaagtggcggttctgggattaggcgcaatggggcacgcatttgccgccaacctgctgaaaaaaggctttcgcgttcatggctggaaccgcacccgcgcgcgcggcgaagatctgctggatgcgggtttgcagctggctgactcgccagccgaggcggtgcgtgaagcagatgtcgtgatcgccatgctgtctgatggcgacaccactgagcaggtgctgcatcaggtcaaagaggcgtttaagcagggcgcgacgctctgccagatgggcaccatcggcgtagaaaaaaccgacgcgctgatcgcctttttcgcagaaaaacgccccgatttgttactgatcgatgcgccagtctccggcaccaaagcaccagcagagaatgcgcagattctggtgctggccagcggcgatcagagccgggcgcaggcggcagaagcggtgtttgctgccatcagtaaaggcacccagtggctgggtgaggcgggaaaaagcacccggatgaagctggtgatcaacagctggctgattggcatgatgcaaagcctggcggagagtacccggctggcagagcagttcggcttttccaccgacgatctctggcaggtgctggagggcggtccgctggccgcaccgtatgcaaaaatgaagctcgggatgatcgccagcgacgacttcacgccgcagatgcatctggtctgggcgctgaaagatgcccgcctggcgctggatgccgcagagacgccgctgccggcgctggagaatatcgcccagctctggcagcaggcggtagaggccggacacggtgaagaggatctggcggtgatctaccgctacctgaaggcgcaatgagtcagcagcattttgacttcagcacgcgtccgctggtgccgctggcgcacgattatctgcacggtgccagcgaaccctggcaccagcacgcctgtgcccagctgatccacaccctgagcggcgtggtacgggtagagacggagtatggcagctggattgtgccgccgagtcgcggcgtctggctgcccgcatttacccgtcatgcgctgcagattaccggcagtgtggcggcgcgcacgctgtttatcgatccgctggcgcgcgccgatctgcccgccagttgtcaggtggtgcaaatctcaccgctgctgcgcgaactgattgtcacggcgctgagcctgccagagcgttacgccgcaggcagtcgggccgagcgggtgatggagttgattctggatgaaatccgcggcatggacgtgctgccctttgcgctgccgacgcccgacagcccccgtttacaggcgctgtgcgagctgattcagcagacgcccggtgagagctggacgctgctgcgggccagtgcccacctgaatgtctcgggccgcactctggcccgccattttatgcgcgaaaccggcctgcagttcagcgactgggtgcggcgcgcccgactggctatcgccctgacgcgactggctcagggcgactccgtgctgcgggtggcgctggagctgggctatgaaagccccagcgcgtttagtgcgatgtttcgtcgtctgctgggcgtctctccgactgactattttccgcctgcagaaactggcctgccgcgctgagcagcgcctgcagggcggcgcgggcggtgtcattgtcgatacttactccccaggctcgcgcgccacgggcatccacgcagctgatataggccaccgagcggctgtcactgcgtcgtcccagcgtatgctcgtgatagtcctcaatggtcagatgcagatcaaacgcgctgcgcagggcattgaccgccgccgacagccagccgttgccgctgccggtcagcatcagcgattgcgtctgatacaccacgctggcgctaatctgcgtctgcccgccgctgtcactctggctgtcagcccgctgtaatgccactgcgggctgcgtgacgccatactggcggcagaagagctgccacaacgcgtagtgcgtcatctctccgccgtgccggtcagtctcccgctgaacacagcggctgaaatcctgctgcagcgctcgcggcatttgtaacccgtgattctgctccagcagccaggcggccccgctttttcccgactggctgttaacgcggatcaccgcctcatagctacagccaatgtcggccgggtccagcggcaggtagggcatctgccactctgtttcctgctgttcggcgcggatggcgaacccttttttaatcgcatcctgatgagaaccagagaaggcggtgaagaccagctcgcccgcatagggatggcgcggatgaaccggcagctggttgcagcgggttaccacttcaatcacctcatgcatctggctgaaatcgagctggggcgaaacgccctgggtatagagattcagcgccagcgtcaccagatccacattgccggtgcgttcaccgttaccaaacagacagccctcgacccggtcagcgcccgccagcagcgccagttctgcgcaggcaacgccggtgccgcgatcgttgtgcggatgcacgctgatgcagacggcatcacggcggctgaagtgacggcagaaaaactcaatctgatcggcataaacgttgggtgtgttcacctccaccgtggcgggaaggttaatgatcatcgggcgctgggcgtccggttgccagacatcggctaccgcctcgcagatctccagcacaaactccggctcggtaaagcagaaggtctctggcgaatattcaaaggtccagtgggtttccggctgcgcctcgcattcggcgcggatctgccgtgcaccagcggtggccagcgccacgatttccgctttgctctgtttaaatacccgctcgcgaaacagcggcgcggtggcgttatagagatgtacgatggcgcgtggcacaccctgcagcgccacaaacgtgcgggcaatcaggtcctcccgcgcctgagtcagcacctgtaacgtcacatcctccgggatacgctgctgctcaatcaggtcacggacgaaatcgaaatccgtctgcgacgcagagggaaaggcgacctcaatctcccggaacccgcagcgcagcagcagatcccagaaggccattttgcgttcccgatccatcggttctgccagcgcctgattgccgtcacgcaaatcggtggagagccagcgcggcgccagggtcagctggcgtgagggccactggcgatcgggcagggtgatcagcggggagggacgatatttatcagcgggtcgggtcagcataagagtctcctgtggtttttttatcagtctgccgacacgcctccgggtccgcgcgcgcagggctgacaacctgacgcgcaaaagtgacaatacccagcatgaccagcatgaccagcatgaccagcatgaccagcatgaccagcatgacctgcatgacctgcatgacctgcatgacctgcatgacctgcatgacctgcatgacctgcgtggccctgcgtgcgctctggtttggtgaatccgccgggcagggttagcatggtcgcctgtttatttgggtggactcatatgctgatttttgacggtcacaacgatctgttgcttaacctctggctgcatcatcgtgatgcgcccgcgcaggcgttttatcaggggattgaacggggccacctcgattttccgcgcattcagcagggcgggctctgcggcgggctttttgcaatctttgtgcctccgcaggagtacattgcccgtaccgttccggcacgtgccgacgaaccgtttcaaccgcttcagatcatgtggcaacagcttgagatcctgcagcagctggctgatgcgtcaggcgggcgggcgcgactctgccgcagccatgacgagatcgtcgcctgccgcgccgcaggcgtactggcgatggtggcacacatcgaaggtgctgatgcgctggatgaggagggcgagcaactgcacgccttctggcaggcgggggtgcgcagcatcgggccattctggaatctggccagccgctttggtgaaggcgtcagcggcacctttcctggctcgcccgacaccgggccaggcctgacccgcgccggagagaggctgattcagcaggcgagtgacctgaagatgatgattgacgtgtcgcatatgaatgcaaaagccttttgggacaccgcccggctctccagcgcgccgctggtcgccagccactccaacgcgcatgctctttgcccgcagccgcgtaatctgacggatgaccagctggtggcaatccgcgacagcggcggtctggtcggcattaatttcggcaacgcttttctgcgcgccgacggtaaacgcgacgctgacacgccattaacagaaattgttaagcattgtgatcacatgttgaagataatgggcagcgaccatgtagcctttggctctgatttcgacgggattaccccaccggctgcgctgggcgatgtcagcggattgccgcgattgctcgccgcttttcaggaagcgggctatgatcagacactgacagagaaactggcatggggaaactggcagcgggttttacatctgaccgggctgtgataacaatttcctgatgttccgggcttgatcccgacgcgccattggcgcaacatctgcctggaaattgtgacggcggtctcattcaatgccggtcacactgatttcaggcagctcatttactgttaaccaagaggaagtaactcatgtggaaaaaaccaactttcgttgatatgcgtctcggtctggaagtgactctctacatctccaaccgttaatcgttctgcccgccctctgagcgggcattttttttcaacttctggttttcctctatgtttatcaaaatcctcggttcagccgcgggcggcgggtttccgcagtggaattgtaactgcgccaactgccacggcgtgcgtaacggcacgatccaggcccaggcacgcacgcaatcgtcgattatcctcagcgataacggcgaagattgggtgttatgcaacgcttcacccgacatcagccagcagatcctgcatacgccagaactgacccgcaaaggggtgttacgcggcacggcgatcggcgcgattatccttaccgacagccagatcgatcacaccaccgggctgctgagcctgcgtgagggctgtccgcatcaggtgtggtgcacgccggaagtgcatggtgacctcagcaccggcttcccgatatttcctatgctcacccactggaatggaggcttacagcaccgtcccattgcgccactgacgccgttcagcgtcgatgtctgtgatgatcttcagttcaccgcaattccgattatcagtaatgcaccgccttactcgccgtatcgcgaccggccgctgccgggccataacgtggcgctgtttattgaaaaccgcgcgaatggccagacgctgctctacgcgccaggcctgggcgagccggatgcggtgatcctgccgtggctgcaaaaagcggattgcctgctgattgatggcaccgtctggcaggatgatgagctgctgaccaccggcgtgggacacaacaccggcaaggcgatgggccatctggcgctggcggaagagcaggggctgatggcgctgctggcatcgctgccggcaaaacgcaaaattctgatccacattaacaacaccaatccgatccttaacgagcagtcaccgcagcgtcagtttctgacggagcagggaatagaggtgagctgggacggaatggcgatccaccttcagggctaaaacatgcagatcaccgacacgctgtcgccgcaggcttttgaacaggccctgcgcgacaaaggcgcttactaccatatccatcacccgtatcacatcgcgatgcataacggtcaggccacgcgcgagcagattcagggctgggtggcgaatcgtttctattaccagaccaccattccgctgaaagatgcggcgatcatggccaactgccccgatccggctacccgccgtaaatgggtgcagcgcatcctcgaccacgacggcagtaacggcgaagagggcggcattgaggcctggctgcggctgggcgaggcggtcgggctgacgcgcgaagaactactttcagagcagcatgtgctgccgggcgtgcgcttcgcggtggatgcatatattaactttgcccgccgcgccaactggcaggaggcggcctgcagctcactcaccgagctgttcgccccgcagatccaccagtcacggctcgacagctggccgcagcactatccgtggatcaaagaagagggctatttctacttccgcagtcgtctgggtcaggcgaaccgcgatgtggaacatggcctggcgctggcgctggaatatttcaccaccgctgagacgcaaaaccgcatgctggaaattttgcagtttaagctcgatattttatggagcatgctggacgccatgaccatggcatacgagctgaaacgtccgccttatcacaccgtgactgataaagcggcgtggcacaccacccgactggtataacagatgaatgaaaactcgattgccgcgtttcgtcgcggctaccgtatgcagtgggaagccgcccaggatactcatgtggtgctctatcccgaaggcatggcgaagctgaacgaaaccgccgccgccatccttgagctggtggatggcaagcagaatatcgccgcgattatcgcaacgctggatagccgttttccggaagcgggcggcgtgggtgcagatgttttagagttcctgcaatcagcctatgaacagaagtggatacagttccgtgaccccgcataaacctgacgtgaatccgccgctctggctgctggccgagctgacctatcgctgtccgctgcagtgtccctactgctccaacccgctggatttcgcccagcaggagaaggagctgaccaccgaacagtggattgaggtgtttcgtcaggcgcgggcgatgggcagcgtgcagctcggattctcgggcggcgagccgctggttcgtaaagatctgccggagctgatcaaagcggcgcgcgatctcggcttctacaccaacctgatcacctctggcatcggcctgacggagaagaagctggatgcgttcagcgaggcggggctggatcatatccagatcagcttccaggcgagtgacgaaaccctgaatgcggcgctggccggttcgaaaaaagcgtttcagcagaagctggagatggcgaaagcggtgaaagcccacggctatccgatggtgctgaactttgtactgcatcgccataacatcgaccagatcgacaggattatcgacctctgcattgagctggaagcggatgacgtagaactggcgacctgtcagtttctacggctgggcgcagcttaaccgtgaaggcctgctgcccacccgcgagcagatcgcccgcgcagaggcggtggtgaaaacctaccgcgagcggatgaacaccaccggcaatctgaccaacctgctgtttgtgacgccagactactacgaagagcgccctaagccctgcatgggtggctggggcgccatcttcctcagcgttacgccagagggcaccgcgctgccgtgtcacagtgcgcgtcagctcccggtagaatttccctcagtgctgacgcaaagtctggacgatatctggtataactcattcggcttcaaccgttatcgcggttttgactggatgccagagccatgccgctcctgtgatgagaaagagaaagattttggcggctgtcgctgtcaggcttacatgctgaccggcaatgccgacaacaccgatccggtctgcagcaaatcaccgcatcacggcaaaatccttgacgcccggcgtgaggcggattgcagcgacattaaaattggtcagctgcagttccgtaaccgcagcaactcacaattgatctataaaacacggaacctctgatgaaaacgcgttgcctggagataaacggtctgacggttgaactggtgcatcagcccgatgccagccaggccgccgccctgattcaggtgggcgcggggagtcacgacgaacccgatcgctggcccggactggcgcatctgcttgaacatctgctgttcaccggcagcaccggctggcctgatgagggccggttgatgagctggattcagacgcagggtggcagggttaacgccaccacgctggcccggcgcagcgcgttcttttttgaggtcacgccgtcgctgctggctgacgggctggcgcggctgcaggatatggtctgccatccgctgcttgataatcaggcgattggtcaggaagtggcggtgattgatgcggaatatcagctattgcagcgtcatcagccgtcacgcattgaagccgcactgctgcacgccgccgcggcacctgcggaattccaccggttccatattggcagccgggtgagttttggcgatgagctctctgcgctacagcgggccctgcgccagttccaccagcgctactacttcgccagcaatatgcggctctggctgcaggggccacacacactggatgagctggaacagctggcgcgtaacgttgctgccgcgctgccctccggtcagtggcgacaggatctgccaccgccgccgctgaccagcgatacctgctggcagctggcagagaccgcacctggggcgctatggcgcagctggatactgaataacagtgacggtgtcacgttatggcgtgaatttctgctggatgaagcacccggatcgctgctggctacccttcgtgagcaggggctggcggagtcgctggagctgaagtggatctatcaggcgggaggcgcgctctggctggcgctgggcgttgaaacgcatcaacccgaaaccgttaatgtcttgatcgaccgttatctggatgcactgcgccagacgaatgaaccacaacatcaacactaccacaagctggcgcagcagcgatttgtgacactgtcaccgatggagcagttacgccagcgcgcaatcggctttgcgccagatgaagccgtgcctgcgttacagccgctgctggcgcgtctcaccgacgcgccgggcacgctgctgttctgcacgtcgcacccggctgaggaaacccttcagacgcagggattcagccttgcgctgaccgcctggcagccagccccgtctgaggcgctacctccggcgcatttcacattctacccgttcgagactgccttaacgtctgagccgctgcccgcacaggcggtggcattgccgcatcatcagcctgatgacctgcaggcgacgctgatcctgcgaccagagttctggtcaacgttcaccgaagcggcaggcgaagcgctggggcggcggttacgtccgctgtttgccgcgttgcgtcatcagggcggcaacggcagctggcaggaagtggagggcgtgtggcaactgacgctacaactgacgccggatgaggcggtggctgaccgggcgctgagccagattgtcgccgcactgacgctgccggttgaggcggcgcagccttcttcgggggaaagcatcgcgattcgtgcactgctgcggcagttgccttatcagctggccgccactattacgccacattgctggcgggcggcgctgaaaggcggcaacgcggcactgcattcactgattgcccggcggctgagcgcactgtcgctgccggttaaccctgacacgccgccaaagcgcatgacgacgcaaaccggtatgacgcgcctgccacacagcagcgcggacaatgctctgctgctgtttatcccgctgcatcgtcctgaacagctggcggcgctacgcgcgctggcgctgatctacgagccgcgctttttccaacgctatcgcgttgagcagcctatcggttatgtggtcagcagccgctatatgcgctgtgccgatgaagatggggtgctgtttgcgctgcagtcgcccgattacagcgcgctgtcactgctgcgctactgccgcaacttcctgcggtcactgaacgagacgctggcgggttacgatctggcggcactgaaagcgcgtcttctgagccgggaagtggatcagccactggcgtgcttacgcgcagaaaatggcctggtagaaccggatgcggcgcagattgaggcgctgacacttgcggatctgcaacagcttcaccgcacgctgattcaggatcgccgccgctggcgggtgctgttcaccggcggtgaaaatgtgtagcgcccggtataaagttgctgaatttatttgaaaattaccgacaaatctcttcactgtctattccgggcgaactggaccacactcaattcactttgtccgcataaggaattgaccgtgaaaaacttcaaacgtattgcactgcccctgttagccgctgccaccctctacgccccgttgtctcaggctgaggcgatgcactaccagctgaatcctgagcatacgtcggtgattgttgcctggaaccacttcggcttctcaaacccaaccgctgatatccctgatgcaaccggtaacctggtgtttgataaagatcatccagaggcatcacgcgttgacgtgaccctgccagtcagcaaaatcgacagccacgtggctgcgctgaccaaagaattcaaaggcgctgagtacttcgacaccgctaaatatccgactgcgaccttccacagcaccaaagtggtggcgaagggcgacaacaaatttgatgttgaaggcaacctgaccctgaaagggatcaccaagccagttacgctgcacgcgacgctgaacaagcagggcgagcatccgatggtgaaaaagcaggcgattggttttgatgccaccggcaccatcaagcgttctgactttaagctggacaaatatgtcccagcggtaagcgacgaggtcactctgactctgtctactgaagcctacgccaagtaagctttttgggacgtagcggcttgctgctacgccccttattcgttttttctgcgccttcttcccctctgaaatctattctgcccgcctgtttatctgccataaaataatccggatatctcctcatcaactattttctgaacgctttatctggcccggaaaccgggaaaaatgaggcgaaagtcacaaatttgcaacagcacggaataagccactcagtgccgctgtgtggcgaaataaaattcagatgccttctgaaataacccgttgatttatatcgtttcgctctaatctgccttcccgcaaatagtgtgattttgatctcataaaccgccgttcagacacccctgtcaataaccccgtccaaaaaataccgctcgtaactgtgatctcctctgcaaatagcaaccccacgaaccggaagaatggccctcagcagattaagacagcgaggtgagggaaatgcgaattggaatggtgatcagtggcggtgatgtaaccggcattaataattttgtcttccagttagggcgtctgacgcaggcggagatcgtgatatttgatggtggcattcccggcctgctggcaaataaccatcgtgatatcagccagcgtgatctgctcgacttttcaattgcctcaattccggttatgcaatcgggacgcacgcaaaagaaactggtgcgcagcgaatatgaatgtattgcccgccagctgaaaaacgcccggattgacgtattaattatggcgggcggtgacgggtcgctgcaatttctccataccctgtcggagtctggcgttaattgtttcggcgtcggcatgaccatcgataatgatgtcttcggcagtgattacaccctgggtttttccaccgcctgcgagcaggtattaaaagaggtcgcgaaactgcggaataccgggcgcgccttacctggccgggtatttatgctggagttactcggcggctactgcggcgaattaaccctgcagtcggcgattaaatccaatgcggacattgcgctgatcccggagtgccagattcctttgccacagctggcgcagcgcatcacccagcgactggcagaacagaaacagcgtgatcattctctgttcagaaggctacacccgcgaatattcgcccggttttcagggggctatcgacaccttaatcaaacagcttgagccgcttattggcgtacgcgtccgtaaaactatcctcggttacgggctgcggaatggtgatcccacctgcgaagagatttatcagggcaccattatggccagtgaagtggtgcgttgtattcagtcaggcatgcggaataaagcggtcattattaacggcagcaataaaccgattccgattgatttaataagcatgcaaaaacgcctggtcgatattgacgggcaccattacaaactcgctaaacaactcaatatattgtgaggagaaaaccatgctgaaaatattatgtgtctgtggttgtggcttaggatccagttttgcgattgagatgagcgcaaaagcggttttaaaaaaactggagattgaggccgatatcgatcacaccaccatttcagaagcgaatgcctttaagtcggacatgattctgacgcaaaaagcctttgccgatgtgttaaatgccgacgccagtccggaacagattaagcgggtcattattcttaaccggctcaccgataaagcggaaatagagcagaagatcctggcctttttaaaagaacgcaacgtaaaggtcgccgcccatgaatagtgtgatcgacttcctggtaaaagatctgctggggcaggcgtctattctgatcgcctttattgccctgattggtctgctgctgcaaaagaaatctgcaggcaaggtggtggaaggcacctttaaaaccctgctcggttttttaattatgatggcgggtatcaatattattgtgggaaccctgacgttcctcaataccatttttacccacggctttggcatgcgcggctatatcaccgatgttgccgccattgccgggctggctaaccgtgagctggggtctgaagtggcactgacgctgctggtgatctttatcgtcaatatcatcatcgcgcgactgacgccctttaagtacatcttcctcaccggccaggccctgctgtggatggcgacgattggcgcggtgattggctataaagcggggctgaccggtctgccgctgatcctgaccggcggtatctttggcgggatcatggccgtggtgatgcctgcgctggcgcagccggtggtacggcgtattaccgattcggacgacgttgccctgggtcacttctgcaccattggttatctggtcactgcggcggtcgccaaagtggtcggcaaaggatcgcgatccactgaagatctgaagctgcccgataacttcaagtttctgcaggatacctatctgtcgatggcgctggtgatggtgccgatgtacctgatccccgctgtggcggccggaccggcgtttatcgcccagtacagcaacggcatgaactacctgatgtacgcctttatgcagtcgattcagttcgtggccggagtctttgtgctctacagcggtgtccgcctgctgcttaacgagctggtgcctgccttccgtggtatcgccatgcgtgtcgtgccggatgccaaaccggcgctggactgcccggtgatgtttccctatgccccgaacgcggtgattgttggcttcctcgccaccacgctcggctcaattgtcggcatgctcgtcttcccgatgtttggtctggcgatgatcctgcctggcctgctgaccaacttctttgccggtggcaccgccggggtatttggtaatgccatgggtggaaggcgcggcgcgatgatcggcggcttcgtccacggcctctttatcaccattctgcccgccatcctggtgccgatgctggagagctatggcttcaccggtgtgaccttcagtgactcagatgtcatcagtaccggcctggtgctcggccacgccttccagaataactggctgtttgtcgccctgtttattgcctttgttaccgcgcttgcctggtttgttaatggcaaatccacaaaacctcaagaggaaaaaatccatgaaactttataacttcgccgatctgttacagctggctaaacagcgcgactttaaagcggtgggttcttttaatcttcactgcctggagatgctgcccgcctattttaaagcggcagagaaaaccaatagtccgttaatgattcagatctccaccggtacggcgaaatatctcggccataaattactggtcgatgccattaaatcgctgtcagagagtatgaatgtcccgacctgtctgcatctcgatcactgttccgatttagcggcgattcagaccgcgattgatgctggattcagttccgtgatgtatgacgggtcccatctgtcaattgaggagaatattgccaatacccgccgggtgattgatatggcgcgtccgcacaatgtttcggtagaagcggagctgggcgcgattggcggctcggaagatggtaaatgtgtggagatggaggcgattgcgtttacgccggtggaagatgcgcgccgctttgtcgaagagaccggcgtcgatatgctggcgatctccatcggcaccgtgcatgggctttacaccggtaaagcgcatattcagcatcagcggctggcagatatcacggcggcaacccacacgccactggtgctgcacggcggcaccggcgtcagcgatgaagatatgcggctggcggtcagcagcggtattgagaaggtcaatgtcggcaccgaaatgaatgttcagtgggtggcgcagtgcaaatcaacctttgaaaaaggcaaggtcaatgacagcgtgcgtaatttcctggtgccggccaatgatgcggtaaccagtgtgctggtagagaagatgcaattattccggtaatcgcccgtttcgccatcaccggcttattgcgtcaaaccttttataattacctattaatctgagccaccccgacatgctacggggcaggagagcctatgtttggattcttaaaaaagtctccggctgtggaacaacccagcgagcagcagcaggatcatctggcggaattaagtcgcgagaaaataacgcaactggagcagcagctggctattaatccgcgtgatggcgaaacgcaaaaacaattaatgctggaatataaccgggcattaagcttatttgcgaaaagccgtcgctatcgcaatgaaattgatgcgctgtttgtcaaaatcgatgaattacgcaatgtggttcgccagtcgatttaaggagagctgatgacgattaagcagttattgcaagaggcaaacgctattcagattggtatcgacgccacggactggcgtcaggttatcgcgctggctgccgaaacccctggtcagtggcggctatctcgatgcttcttatcctgatgcggtcattgccaatacgctggcccatggcgcttactacgtgtttgaagaggggatcgccattccccatgcgcgaccggacgcaggggtgatccgcgactgtttcagtatgattctgttgaatgagccgatctcgtttgagggcagtgataaagcggacattgtgattatgtttggcgcgcgtgacagcaatgcgcatatcgaagaggggatccgcgcgattgtgtcgctgctggaggatgaggagacgctggtccggttacgtcaggccagcagtgtcgcggaggtcatcgatatcttatgacgcaaaacatcccccccaaacgcgtggtgctggttaacggtattccggcatcgggtaaaagcaccctgacgcgcgtgctgtcacaacagtttggctggccggtgctgacgctcgacagcctgaaagagccgtttatgcacgcttttgcgccggtcgatcgccagcgtaaccggcaactgggctgcgcggcctatcaggcgatctggaacatcgtcgcgcaggcgcccgccagtcagatctggctgatcgacgcctggtttgggttccagccccgtacgctgctggagcagggactgaaacaggcgggcgtggaggaggcgctggagctgtggctgaagattgaaccggaagcggcggtggcgcgctaccaggcgcggctgtcgcagcggctgccgggccatccgggtgcggagtatctgccggagctgcgccagctggcacaacaggccactccgatggcgctgggcacggtgtatgaggttgatgcctgcgttcaggatcacgctgccgtcattcactggctgcagcagcaactgaccagaacccgctacacttcagttcatcatcagaggagtgaggagttgcaggatgtcgtcgcccccgtatctgcaaaccggtgaaagcgccgtgctctacgacggcgtctgtaagctgtgcaacggctgggttcagttcctgctgcgtcgccatctggcgcggcaggtccgttttgcctcggtgcagagcgagcagggcaaagcgctgctgcgctgggccggactgccggaagagaacatcagcaccattgtctacattgccgataaccagcactggctgcgggcgcaggcggtgttccgcgtgatgcagcacctgccggcaccctggcgcgggctggcggtgctgcgccactttcccgacgcgatcagtaattttgcctatgaccgcatcgcgttaaaccgctataagctgtttgggcgttacagcgcccagcacgctatccaacccgattatcctggtcgatttctgcatgaggtggagcagacggtcacggaagggtaaataccgtccggcaacggctgtcgtcgctctgccattcctccgcgatatcacttaatggacgcgaccggaaaggaatggtaaaaccgtgcggtccggcggcctgcagcatttcccctattgaggcgatcagttcacggtctggcacactgcccagcccgcttcccatcagtgttagcccggatgagcgcagcagcttactgtgcagggaaatctcctgcccgctcagcgaaccaatctgcacaaagcgcacgattttttcgccaccccgaaccgccgcagtcatgattgccagtgcgctctcaccccacagataatccagtactacatcaacgccctctgccatcagggcggggagtttcggtgggcagcgcatccagcgtcagagtgatatcagcaccctcattgtgcaactgctgcagcgtttctctgttacggccggtggcaatgattttgcctgcacccagcgcgcgggcaatgcggatcgccaggcgacccgaagtgccggtcgcgccattgatcagcacggtctcgccggggcgaagtgcggcccgacgggtcagcgctgtccaggaggacatgcccggattcgcgagagctgctgccagcaccggatcaaggccagaaggcagtgggatgatgtgttctctactgaccaccgtccgctcggccatactgcccgaggcggagtcaaaagccagaaagtagacagcctcgccgttgtcgaggtagcccgttccgtcaatgcccggaataaacgggaattgcgaaacggcgctgtagtggttgcccgccgcccgggctttcgccagctggctgagtgctgcggctctgacggtgatccgctgctgatgctcaccggcctggggttccggtctgtcaccgtagtgaggttttgcgcctgcctgatcgattatcgctgctttcatggttgatccgccttctgtctgggagttattaggtgtaaagtacacacattattcctgcctcaggatggcgtcaatgaaaagtgtgcaaaatacacataaatacgatgcgctgcataattgtctgctgacaattgcaggtgcgcttaaccgcccccagcgcgatatggcgatgattaaagcggcgggtattgaactggatcgggcgctgtttccgctgctggttcaggtcagccggttcgggccgatcggcgtaggcgaactggccgatcgggtggggcgtgactacagcacggtcagccgtcaggtggcgaaactggaggaaaccgggctggtcgtgcggcagaaaaatcagcaggacaaaaggattaacgaggcagccattaccgcagatggccgggcgatgaccgataaaatcgatgcgcagcgcgtgcaggtctatcagcgcgttttccggcactggccggacagcgatcgcgaggcgctggagcaactgctcagcagatttgttaccgattttaccctcacggaaggtgacgaaaatgatgacaagcatgatgcggtttaagggaagagggatttatgccggttaatttcgatctcaacgatctctatgcgtttcgcgcgctggtggagtttggcaattttcgcctggcggcagaatcgatctgtctctcacagtcggcgctgagccgccggatagataagctggaaacctcgctggggatcaaactgtttgagcgtaccacgcgccgcgtcacgctgacccttaaggggcatgcgtttgctcagcgctcggataagttgctggctgattttgaggaggtcatggccgatctcagtgaggtgagcttagcccgcactggcctgattaccgtggcctgcgtgccgtcagccgcctactactttatgcccaacattatccggctgtttcaggcgcgctatcctcgcgtacgagtcaaactgatcgacagcagtgcggctaacgtttatgacgcggtgattggcggtcaggccgactttggcatcagtttttccagccgctcgcagccggatgtgcatttccagccgctgatggatgatccctacgtggcggcctgtcggcgtgaccatcctgtagctggcaaaaagagtctgagctggcaggcgttttatcagtatgaatgggtcgggctggataaaacctccggcaatcgcaacctgctggatcaggcgttgcaggcgatcatgccggagaaaccctgtatctgtgaaacccggcacgtcaccaccatgctggggatggttgaggcggggctcggtattgctgccgtccccgccatgtcgatgcctggctacgatcatgccctgctgatggcggttccattgaccgatccgcaggtgaaacgcaccgtgggtctgctacgtaaaaatggccggacgctgtcgcacattgcgggcgaactggagaacctgattattgaacagtatcagcgtctctgaccggttttgacgctttcacggtgtgcagtccgctggcgtgcaccgcctgttgtgcttcagaagaggcgagccagcgcagcagcttcgccgcctcatccggctgcgctgacttgcgcaccacggcaccggcgaagcgggtggtgtattgcagcttgtccggcagtttcgccaataaaagtgacgcctggcaccggcagcagctcactgacctgctgaaagccgatagcgtatttaccggccgcgacctctgaggccaccgggatgcgctcaaccttcaccgctttccccttaacctgatcttcaatgcccaggcggctgaacagctggctgctgacatacttaccgctggcgctgtcagagtaggcgatggagctggcgttcagcagagcagtacgcagcgcgctttcgctgccgatcttaaccggcgtggcaccctgtctgatcaccgcgccgatgcgggagtccgccagctcaacccgtgaacccggcagcgtctcgccctgtttttgcagatcgcttagcgcatcgccgaccataatcaccacatcggccggttcaccgcgcgccagtcgggccggaatcgcctgcggggttttgcccatagacggaccggcgacggtgttgatagtgatcccttcacgctgggcgaagcggggcgagagcgtatcccacgctgctttaaacccgccggagatcatcaccgtcagctcttttgcctgcgccgtggcgctgcccgccacgctgaacagcagagcagcgtacagcgacatcgttttcagtttcattttacgttcctcagctaacggtttcatgggcaggcgatacggcactgcgtgtacgacgatagagataaagtgttgcccccagggcgcagactgctgcaaaactcatccagtagcctggcgaggctttatcgccggtcatctcaatcaggccggttgacatcaccggcgtaaatccgccaaacagcgcagttgccaggctataggccagcgagaagcccgccacgcgcacttccgctggcatgatttcagtcagcgccgggatcatcgcgccgttgtagagaccatagatcattgaaagccacagcagcacgcccagcatcatcgagaagcccggtgcggcggccagcatgctcagagccggataggtggtgactattgccagcagggtcatggcgaccagcacaggcttacggccaaagcggtcggagatcgcgccgccaatcggcagccagataaagttcgacaccgccaccagcaacgtcaccagcaggctgtcagaggcgctgagcaatagcactttcttgccaaaggtcggcgcgtaaaccgtaatcaggtaaaacgcagtcgtggtcattgctaccatcagcatcccggcaatcaccacctgccagttggcgagcaggatgcggaacacctgcttcacatcgggatggctgcgacggttgttgaactcctgggtctcttccagcttgcgacgcagcacgaaaataaacggcacgatcaggcagccaaacaggaacggaatccgccagccccattcacggatggcactctcttccagcaccgcgttgaggataaagcccatcgccgccgccaccataatcgcgacctgctgactgcccgactgccagctggtgtagaagcccttgcggcctggtgtggcgatctctgccagatagaccgacacgccgcccagctccgcaccggcggaaaagccctgcagcagccgaccaatcagcaccagcagcggcgcccacagaccaatactctggtaagaggggatcagcacgatcataaaggtgcccgccgccatgatggagagcgtgacgatcagccctttacgacggccaaccttatcgatgtacgcccccagcactaccgcgccaatcgggcgcatcaggaaccctgcgccaaacacggcaaaggtcatcatcagtgaggcgaactcactgctggccgggaaaaaggtatgggcgatataggtggcatagaaaccgaacaggaagaagtcgaactgttcgagaaagttgcctgaggtaacacggaatattgcgccaatcctggcgcggtgagtcatgggtgaggttgtctgcatcagtaactccagtaaggtttgacgctttttgccgcgcctgtcactgaagagtggatcagcgcccggcgctaaataagtgcaaaaagggcatcgattaatgtgccagccgcatgattgccaggcgttatcacttaaagtgtttcgcattcaacaggttaaatggcgggatggtttttttgtgcctgttagtgagcctgagaggagtttgcggaaatgtgacagatttcataagcgtgttgcaggcgaatagggggaatctggcttgtctgaggccatcagcgcagagtctggcggcaaagagggttcagaacgcaggcagcaaggcgtcagggaaaggttatgccaaaaatctgatgtaaatgtcggacgcccgctacggtaaacaccacttcacggtagccaggctgccgggttagccagccttgcgtttcaaaggcactcagcagtgctgcacccgcgtagccgccgagatggaaccggcgctcactccagtcgagacagccacagcaggctctgcggcgtccgggttgggacagatcaatctgcaacgccgcaaactgctgctgtccatataaggtgacagcgctgccttccggtgtgatccagccctgttgcgccattacggcatagatctgcaccgcaatatcaccggccagatggtcgtaacaggtgcgggcggtgcgaagcgatgttggggtggtgctcgccggcgcggcaatccgtcgccacgacacgcccatcatgttctcaatcagcgtagcgatgtcactgccggtcagtcggtaataacggtgacgcccctgcgccacgcagacgatcaagccgctggtgatcaaccggttcagatgggcgctggcggttgagggcgccacgtcggtgacggcactgagttcggtggcggtccaggcgcgtccatccatcagcgcggacagcatcttcacccgtgacggatcggccattgctgcggcgacgcccacaatcgcattctcaagtgcttcgctatcgtcaggtgcgttatgcggttgtggagttgccatcagattacagtgcccattctgtggtcagcccggcggctgatcgattgttatcggtaatcaggatcagctggttagcgtgatcgctgtattgcaccaggatgttgattccggcatcggcaaggcgtgcagtgatcgctcccagctcgccgggacgctgttgcggtaacctgcgaataagcgggacgttaactgcctcgacggcgataccttctgcttcaagcacggcccgcgcccgttcgccttcctcaaccagaaaatgagcgtggctctgctcaccaaaggagaacaggccgccgccttccaggccaatcccatgacggcccagcagcgtggtgagccgggaaagtgtgcctggactattttgcaggatgacatgaatatcgaacatgttaatttactccctgttgtgaggcatattctctgatcagcgtgacgatgcgaagacgataaccggcaaaaagagtctcgcggccttcacgctgtgcggcctggtgacagaggttgcgcttccaggccagcaccgattcttcatcgcgccaccaggagagcgagagaatttttttctcatcggtcaggctttgaaagcgctcaagagagataaacccgctgttttgcatcagcagcggtttaaggtcggcagccagttgcaggtaacgcatctggtgttcgggtcgggcttcggcttcaaatagtacggcaatcatcgctatcctcctttgggtgatagcgcaaaaatagcgggcggggcgggttgatgcttcgtccggtaacgaaatatggctgcaggggcgacctccagccggtgcaatcttgtaatggagcagatgatatgttcagcggactcagtgcgttcccccttactccctttgcggcaggcaagcccgatgaggcggcttttttgcggctgctgcgcaggctgattgatgcaaaagtcgattcccttggcgtgctggggtccaccggcagctacgcctatctcacccgcgcgcagcgcaggcgcatcgcagaaactggcggtggaacatgcagagtcgattccggtgatgatctgcattggtgcggtgggcactgacgaggtgctggcgctggcggaggacgcgcagcaggcgggcgcggctgccttactgctgccgccgctgggttatcaggcgttgaatgaagatgaggtgttcacgcttttcgagaccgtaacgcaacacgcctcggtgccagtctgtatctatgacaaccccggcaccacccattttacgttttccgatgcgctgctgagccggatcgccacactttccggtgtcgggtcagtgaaaattcctggggtaccggcagatcaatctgcggctaacgatcgcctcgctcagctgcgcggcacgctgccagatgccgtgtcgattggcgtcagtggcgatgcctcagccgccaacgggctgattgcgggctgtgatggctggtattcggtgtgcggcgggctgtttccgcgcgtcgcaaaagcgatgaccgaagcggcggccgcaggtgaccatcagagcgtcagggcgcagtccgatcgcctgcagccgttatgggcgctgttccgccagcatggcggcagtttccgggtgatcagcgccgcggcggggctgctgggactgaccgaacgcgactgtctgccgcgcccgctgttaccgctctctgcggcggactgccagcagattgctgacgtgctcgcggcactcgacctctcttaagatcccgcgccagaaggcattaaccgtggcgcaccaggttaaagccttcttcctcctgcggcgcttcgaaatagcgggtaatcagcgcgaactgctcgtccgttgcggcaaaggcgtgttcgccgtcctgatttcgggcgtgcaggcgcgatttacacagcgcatccggtacgtccagataatgcaggcgatggtcggcagaggatgccttaatcaccgacatcatccagtcgcgattcgcccgggtgttggcaggaaaatcgagcaccaccgacacacctgcgttaagcagcgcgaccagatgaggcgtcatcgcctttctgagtttttccgcatagcgcacgtaatcggccaccgactgcatctcgtccttatagagcgcggcgagccactgatcctcgctgatcaccacgcaaccgggggcggcgctcagctcagccgccagcgtcgatttcccggaggcaatttttccacacagcagatgcagcgtggcgggggcaaaagtcatggtcacatcactcctgtgtcagcctgatagtgaaccgcgcgcattacgcgaaaggaaggtaaagcgattctctccgaagcgggattcaggctaacaaaacaggggagagataagcaatgagaggcataaagtttaaaacccgaatttaccgcgcgtaacagtctctgctgctgcgggcgttactgcattcagaaaaaaccgcggctttcgctgggcacgttgacacgcctgaacggggaagtgcgctcaggcgtagcgtgggatatcagatacgctttcagaaaggggtgaatcggcgctgaacagctggcaactgacttcatttttgtgccatcagcaacgtcagcagttcgcggcagcatgcctcttcttctgcactgtctgcggatgccaggtggcgcagcagttccatacagcttttttccttgcccgcttccagtaactcttcgatcagaaagttgagtttgtcctgttcagacacggcaaaggatgaactaaactcatttttgaccgggccactgtgattcaccggcaacgtgagggtgttttgcattggcataatattgtcctgtttcgggttaaaaaatgttcggcgattgctattaaacttatacaacgatccggaatttgtacagaaatctggccgattgattttcaggacgaagctaagcgcagcgcggttgcggcgtaaatgtcagctaatcattaagttagcgtgagaaggaatttcagaaaaattctgcgggcctgaagcaggatgcggagacgggaaaaaccaggtcagtcctgcgtcaggtcagcaggcggcccaccgggccgcatgcactatttagcggtcaggaaatcttcgcgctgcggtgtaaacgtatccagtaacgtgcccgcctcaaaacagacacagccatgaaccacattgggcgctttgtagagcgtatctcctgcgcccacctcacgcgtttcaccattgatggtgaaggcaaaacgtccgctcagcacataggtcagctgctcgtggggatggtgatgcagcgggccgacagcctctttctcaaaaatcacttctaccgccatcatggtgccgccgtacgccagcacgcggcgggtcacgccattgcccagatcttccagtggtcgctctttatggtagataaacatcgcaatcctcctgcggttgcccctgctgcggtgaccgttttgtgatggatctcacagcactcgggtgaattagtttatgcactttagtggtttttcactaaaatgaaacggtgtttcaattaatttataagggtagatcatgaaaatcgcgttaatgatggaaaacagccaggccgctaaaaacgttaccgtgctgaaagaactggaaggcgtcgcacagccgctgggccatcaggtcttcaacgtcggtatgagcgatgagcaggatcaccacctgacctatattcacctcggcattcaggccagcgtgttgctcaacagtcaggccgtggatttcgtggtcgcgggctgcggcaccgggcagggtgcgctgatgtcgcttaacattcatccgggcgtcgtctgcggctactgtatcgatccggcggatgcctacctgtttgcgcagatcaacaacggtaatgccttatctctgccgttcgccaaaggctttggctggggcgctgaacttaacctgcgctttatctttgaaaaagccttcaccggcgagaagggcaatggctatccgccagagcgtaaagagccgcaggtgcgtaatgccggtctgctgaatcaggtcaaagctgccgtgatcaaagagaactacctcgacacgctgcgcgccatcgaccctgaactggtgcgtactgccgttagtggcccacgcttccagcagtgtctgtttgagcatggcaaaaatcaggaaatcgtcgcttttgtgcgtcagctgacccactaacgcatccggggtcataaggccggtctgaccggcctttttttattctctcttttccgacatcagctgaacgtcagctctgctgcgccagcgccggattgtaatgacgactcgcctctaccagtatccgggtgtagggcatcgcggcccggtcggccaccagcgtcggcacatccagcgtctccagcaccttgccctgttgcataaccgccacgcgatggcagaggtgcgccaccacgccgagatcgtgcgtcaccatcagataggtcaggttctcctgctgctgcagatcgctgagcagattgaggatctccgcctgcaccgaaacatccagcgcggaggtcggctcatccagcagcagcacgcgcggctctaaaatcagcgcccgggcaatcgccacgcgctgacgctgaccaccggaaagctggtgcggataacgcgtctgccaggcacgattcagcccgaccttatccagcatcgccacgacgcgctgctggcgctgcccgataccctgaatctgtaatggctcttcaaggatatcgcccagcgtgtggcgcggatgcagcgagccataagggtcctgaaacaccatctgcacctgacggcagcgcgcccgatcgatgcggtgcgccagcggctggccatcaatggtcagctctccctgccagtgattaaacaggcccgccagacacttcagcaccgtggttttgcccgagcccgactcaccgaccagcccgaagatttcaccctgtttaacctgcaggctgacgtcgaacagcacctgattacggcgaccctcttcaccaaaactcaggttgagatttttcacctcaatcatcgtaactccttagtcagttagccagctggcgtgacgttgtaacacaggcagacgcgtgcgccgccgatcaaggtcgggcagtgctgccagcagtccctgggtgtagggatgctgcgcgcggtcaagttcgctggcggccagcgactccaccacgcgcccggcatacatcaccagcacccgatcgcagaagctacgcaccagattgatatcgtgactgataaaaatcagtcccagaccgcgcgctttcaccagatcatccagcagcgccagcacctgcaggcgaaccgagacatccagcgcagaggtaggctcatcggcaatcaccagttccggctcggtgatcagcatcatggcgatcatcacgcgctgcccctggccgccggaaatctcatggggatagagctgatatacccgttcaggatcgcggatctgcacctcctccagcatcgccagcgcccgctgacgtgccgccgatttctggccgcgatggtgactgcgccaggcttcggcaatctgttcgcccacccggatcaccggattcagtgaatatttcgggtcctgcataatcatcgagatgcgtttgccacgaatagcgcgcatctctgccgggctggcgtgcaacaggtcgatatcgccaaactgcatccggctcgcctcaatgcgcgccttagccggatgcagctgcagcagggcgcgacccacggtcgatttaccggagccggactcaccgacaatcgccagcttctcctgaccgagctgaaaggagacgccacgcaccgccggggttatctggcgtccgttaacaaagttcacgtgcaaatcgcgcacgtcgagcaacggcgaggcgttactcactgcggggatcgagcaggtcacgtaggccatctcctaagaagttaaatgccaggctattaatcaggatcgccagaccgggaacggtcaccacccaccagcactccagcatgtaggtgcggccactggcgatcatcgcgccccattccggatccggcggctgcgcgcccagcccgagaaaccccagcccggcggcggtgagaataatgcccgccatgttcatggtgatgcggataattaccgacggcaggcagagcggaataatgtgcttccagagcacccgcaacggcgacgcgccctgtaagcgcaccgccgagataaagtccgcctgacgcagcgacagcgtttcagcgcgggccagacgggcaatgggtggccaggcggtgagcgtaatcgcaatcaccacatgctccagacccggccccagcgcggcaacaaaggccagcgccagtaccaggctcgggaaggaaataaagatatcggtgacgcgcatcagcacgccgtcgactttgccgccaaaataaccggcggtgacgcccagcagcaggcccagcggcccgacggtgaccgataccagcagcacgatgtagagcgtgatgcgtgcgccccacaccagacgactgaagatatcccggccaaactcgtcggtgccgaaccagtgggccgcgccgggaggcgtcagcgcattgttcagatcctgaaccagcgggtgatacggcgcgatccagggcgcgaaacagcgccacgatgcagagcaccagcacaatgccaccaccaatcgcggtcaggggattacaggccatgcgccagaggaaatagccgcagcgggcagcaaaacgctgacagcgcaccagccgctcacgggaatgactcacagacgcagcgtcaaaagagatcgtcatactttggtcctcggatcgaacacctgatagagcaggtcggagatcaggttaagcagcacaaaaatcaggcccaccaccagcacacagcccatcaccgcattcatatcgcccagcatcaggctgccggtgaggtaggagccaaagccgggccaggagaagacggtttcaatcagcaccgcgccctccagcagcgagccataggccagcgccaccacggtcagcagctgcaccaggatattgcggaaggcgtgctgccagatcacctgccattcggtcaggcctttgacccgtgcggtcagaatgaactcctgcgacagctgcgcgagcataaagctgcgcgtcatgcggctgatataggccatggagtgaaagccaagcagcgaggcgggcagcaccagatgattcagcgcattccagaacacctgactgttgcccgccagcagggcgtcaatcagcataaagccggtgcgacgtggcacgatgccatccaggctgaagtccacccgacctgcgccgccgacccaaccgagatgggcatagaacagcagcaggccaatcatgccgacccagaagattggggtggagtaaccggccaggctgagcatccgcaccacatagtcgatgacgctgttgcgacgcgccgccgccagcacacccagcggcacgcccagtcctgcgccaatcacaatcgccagcgtggccagctctacggttgccggaaagacgcgcacaatgtcatgcaccaccggctgaccggtgagcagcgcatggccgagatcgccatgcagcagcgcgttaaggtagatgccaaactgcacccacagcggtttatcaaagccgagctggtgataaacctgctgataggtggcctgatcggcgtcggggccgacaatcgccagcaccggatccagcggcattacccggccaataaaaaaggtcagcagcagcaggccgaacagggtaatcactacctgcaccgcgcgatggctgatgcggcggcactgagttcgggtcagggtcaggatcatagggtgcctcccgctttggcttcaggggttttccagacatcgcggaggaaggtggtcgctgagggatgcggctgataatcctgcacccggttactgaccaccacggagtcgagcatttgtgaaatcggcatcagtgcaggcaccagctggtcatagcgctgctggatggcgtaataggcctgctgctggcgggttttgtcgcgctccaccagcgcctgatcgatcatgctgttgagctgcgcgtcgtagaaaccggtgcgccagccctggaagttggtcagccgggcgctgtcagcattattcgggttatagaccagcgcgcgcaggctggagtggggatgcggctccacgccgctgccgccgcgtccgaccagcagactgaactggcgatcgcgcatcgcgccatagatctggttaccggtgccggtgatgatttttgcgcggatcccgccctggagcagcgtcgactgcaccgcgatggcgatgttcagaaatggctgatcggccagcacccgcagcgtggtgtcgaagccgtccggataacccgcttcagccagcagtgcgcgggcgcgcggcacatcgagccagtaaccgggatcgggcagcgtggcgggcatgccagcctgaatcgggcgctgatgcagctcgccatagccggtcatcaggcttttattgatgccctgataatcgaccaggtagcgtaccgcctcccgcactttgatattgtcgaagtgcggatctttcatgctcatcgccaggtagtagatcgttccttttcttaccgcatcaatggtgaggtcggggtcgtgccgcagggcgcgcacgtcggggatcgccatgttactggcgatatccagatcgcctttctccatcatcagccgcagtgtctgcgactcctgcagatggcggaacaccacccgcgacatcttcgcctcgccgcgccagtaatcagccgcacgactcatgcgcagcacatcttttgcctgccatacatccagccggaacgggccggagcccgcttcatgggtggtgagccagcggttgccccagtcgccatccacctcatgctgctgcacggttttgctgtccagcaccaccatgctgcccagcgccgccagcgagtagatcaccagttgcggatcgttaggtctgggcagggtgattaccagcgtgtggtcgtcgggcgcggtaatcatctggtctacattgtcgcggctgaagccgtacgatttccacaccgacgcctgcgccaggttcagatgcagcacccgccgcatcgaccagactgcatcggcgctggtcagcggattgccggagtgaaacctgacgttgtcgcgcaggtgaaaagtcagggtgcggttatccggactgactgaccagcgtttccgccagcgccgggcgcacctcggtgagttgctgcgggttcagctcgaccagtccgtcatagagattcacgacaatgccgaccacttcgttgccggtcatagcggccggatccagggtgagcaggttattcatattcatgccgacgatcagctggtcatccggggtctttgcctggattgacgcgctgcccgtcagcaccagcagcgtgatcagccacgcgccacatcgttgtgtcagggtcataggtaaagtccagcaggtcagaggttttcccgtttacgactctgcctgctgctggccaccgggatggcaggcagcaggcgggcgacggggttattattgtttgccgtacttcggtagtgcgatttaccagcggttcagcgtgtgcgtctcaatccagctgaagttaatatcctcacccagcccgctgcgggtgggcagggtgacaaatccctgatcgtccatcgggtcgatcaggctgttgaggtaggcgggcggtgtttcataatccaggaagggatgcagcaggccgcgctcataccagcggcagttacggatcgccccgaccaccgccaggctggccgcaccgttgccgtgcacttcgcaatccatgccaaaggcttcagccagattcgccactttcagggtgggcgagatgccgcctacgccgttggcaccggctcgcagaatgtcgcaggctccggcacgcacccagtcggcgcggctgtgatgtttaccgcccaggctctccggaccaagcacgtcgatagagaggttttcggccagccaggcgtaagaggccatgctctcttcctccatcggctcctcgaaccaggcgaaattaagcttttccagcgccttgccgatggtcagcgcgtcactgcggctgtaccagtggtagccatccagcatcagcgcgatatcggggcccaccgcttcacgcaccgccgcgcaggctttgatatccatcgccgggctgggggcgaaggagaccggcggcatccaggtgtgcaacttgatcgcctgatacccacgcgccaccagcttttccgcgaactgcgcatactcatccggcgttgataatccaccgctcagctcgtcaccacacatggtgctgccgtaagccgggatcttctcgcgatagccgcccagcagtttgtggacaggctgtttcagcttccgtccaatcagatcccacaatgcctgctccacagcggagagcgcccgctcggtgagctgatgggcgctaccgcgctgccagtgcaccagatcctgccagagacgctcccggtcaaaggcgttctgaccgatcagcactttgcggaaaaaggcattaaccacatgggatcgcaccacttccggcggcgcaaaggcgtaaccacagtcgccttcctcgctggtcagggtcaatagcgccatctgcgcatcattttccgggccagggtgggagtgtccggcgctgtcggcgcagcgttgggtgggataggtaaaaagggtgacatcaatggcgctgatcttcacggttaagctcctgtggcagtctgtcctgatgaattattaaaacgctgtttcattttcaatctagccttcacaattcattaacgcattagccaaaacgatacgattaatggctaatatgtgtgcaactgcccagggtgttgtgaacatattcacgaaagctgaccgttttgtgagcagcgacacgctgcgctttttcctctcaagggatctctttgagtggaactccgccagttaaccccgccgcaaaaaacatttaaccggatgacttcccctgaccactgttttaggtgatagtaacgccgctttacattaataattctcattatcatttgtgcgggtttttacaatgaaaaaatggtttttagcgctggggctgctcacgctggcagggacggcttcggccaaattgattaccgatgtcgcaggccgtcaggtcgaggtgccgcaggaggcaaaacgcatcattctgggtgagggccgtcagatgtatctgctggcggcatttgatactgatgccccatttaaacgggtgattggctggcgtgacgacttcccgaaagcggactgggacggctatcaggcttacgaaaaacgctatccggaaattaaaaaattaccgacctttggcggtgcgaaagatggcactttcaacgtcgagcaggcgttaaccctgaagcccgatctggtgctgatgaatctggaatctaaagccgccaccgatgaaggcaagctgattgaaaaactgcaggcagtaggcgtgccggtggtgtttatcgatttccgcgaagcgccgatggtgaatgctgagaaaagtatccgcatcatgggcgaactggtgaacaaaccggcgcgtgcccaggaaattatcaccttccgccagcagcagattgaccttgtcacctcgcgtctgaagaactttaccggctaccgcccgaaagtgatgattgaccgtgcaggcggctacagcgacgagtgctgcatgtcgtttggcaatgagaactttggtcagatggtcgagattgcgggcggtcgtaacatcgctaaagatctgatccctggcaccttcggcaccgttaacccggaacagattatcgccagccagccggatgtggtggtggtgaccggcgctaactggaagaattacaataccgtgggcaaatgggtcggcgtcggtccgggtgccaatgtcaccgaggctaccgcgcgtcttaaggggctgatgatgcgcgatgcttttaaaaccctgccggtggcgcacaacggcaatgtccacgccatctggcatcagttctacgacagcccttaccagtttgtggctatccaggcgctggcgaaatggctgcatcccgatctgtttgccgatctggatccggacgccaccttccgcacgttccacgagaagttcctgccgctgccttatcagccaggatactgggtcactttacccgctgataaaccctgacagaccggcgatgacagggacgtcatccgcctgatttgcaattcctcctgaataaaccctctgtttctcttcagatttactaatcttttacaggcgcggagtcagttgctctgagcagcgcgacgtctgacgcggtccgcattcacgttaaaaatggagagaaacatgcgcaataccctgggaagatcggcctttgccgtgacgctgtacgctctgctggagccggtgccgctgggcttttttgtcgcggcctggctgttcgatattctctatagccagacctttgtgctgttctggacggatgccgcaggctggctgattgcgctgggactgatactggcgattgtgccgcgactcatcgcgctggtttatctgttccgcggcagtgacagtgcggaaaagagtcatttctggctctggctggtggcgattgcgatcgctatcgtcaatgcgtttattcacagccgtgatgccgccgctgtcatcccgctgggcgtgacgctttcgacgctggtggtagcgctgctgctgctggcgaatgtgcaacttgcgttacgtcagcgtagcgcttaaggaggagcaaccatgaagataccgcataaaacgttgctcgcgcttaccctgacagcactgctggcaggctgtgatgatggtgcgcttgtcgatccgcaaaagcagatcggaccgaatcctgaactgccgcaggcacagaacttctttatgccgccgatgcaggtgccggaaggcacgccgtggaaagcgggcgaaatgccaaaagtggctgacgggctgaaaatcgaaaagatcgctgacaatctgcagcatccgcgtcaggtttatgtgctgccgaataacgatgtgctggtggcggaatccaacggcccggccaaacccaccacccggcctaaacagctgatcatgggcattgtgcagaaagcgtcaggtaagggcggcgctggcggcaatcggattacgctgctgcgcaacgtcaatggcaaatgggagcagcaccgctttattgagaatctgcactcgccgtttggtatgcagctgattggcaatacgctttacgtcgcgaatgctgacagcctggtgaagttcccctatcgcgaaggggagacggagatccgcaccgcgcctgaagaggtgacggaaaactgccgggcgggccgattaaccaccactggaccaaagcgctgttggccagccccgatggcagcaagctctatgtgggtgtcggctccaacagtaacgtcaccgagaacggcattggcgcagagtatcgccgcgccgcagtgctggaagtggacgcggccagcggtgccagccggatctacgccagcggattgcgcaatccgaccggtttacagtgggaaccgcagagcggaaaactgtgggccatcgtcaacgagcgtgatgaaatcggctccgatctggtgcctgactacatgacctcagtgcaggacaaaggcttttacggctggccctacagctactttggtcagcatgtggatacccgtgccgaaccgcagcgtcccgatctggttgagaaagcgattaagcctgattatgccctgagttcgcatgtcgctccgctggggctgctgttctacggcgcagataacatgccgcaataccagggcggtgcgtttatcagtgaacatggcagctggaaccgtacgccgctgaatggctacaaagtggtgtgggtgaaatttgaaaacggcaagccggtgggtcagccgcagacggtggtctcgggcttcctgacggacgacgaaaagcaggtgcgtggattaccggtcggtctggccagcgacaaacagggcggtgtcctgattgctgacgatgcgggtaataccgtctggcgaatcagcgccgcgaagtaagcattgcgctgcttttttaagcagaaagcaggcataaaaaaaggatttggcatttcgccaaatcctttattttttgttcgctacccggctggtaaccgcgctacgaacgaggtgctcagcactctccacaaacaagattgtaaaatgtgcggctaaggatttcaagtttcgccaaaatgctgtatgtttatacaggtgttgagtgttgagcatcgcctcattgtcgactggccgctcccaggggcacggttttaaaatcccggcaggcatcaggtggtgctggcctgtggctttaaccatgagtgccgctcagctctctccacaaagatgtgcttaggcgcccggcgggtagagtcaaagccctggttgccgaacagcgcgctcctgtaaaaggagaaggaaagtgatggaactgactaagctgattctggatcttatccgggtcatcttgcagatcatcgttgcccttatgcaactgaccggtcacgcaggttaaccggaacttgaaacaaggcggagctaaccactccgccttttttctttgtcaattctctgtcatcggaggcgggtaaggtggtgcggcaaagcacgccgccggggcgctgtttatccagaccgggagttttatgtccattgccgccgttatgcccgcccgattagcgcacacctggattgatgagagtgtgaagatgcgcgaaaccactgtgggtcagcagtgtgagatcctggcgcacagcacgctggagtatagcgagctgggtgacttctcctatgtcggcgaacactgctgcctggccgatacgcaggtggggcgcttctgcgccattgctaatcaggtacgcattggcgcgccgaatcatcccatggaccgcgcctcccagcatcgctttacctactgcccggagtattaccaccccgacgcccgacgcgatcaggggttcttttccgcccgacgcgccgatcgggtgataatcggtcacgatgtgtggataggtcacggcgtaattgtgctgccaggcgtcaccattggtgatggtgcggtgctggccgcgggtgcagtcgtgacgaaaaacgtcgcgccctatagcgtcgtgggcggtgttccggccaggccactgcgggtgcgctttacaccggctatcgccgcccgtctccagcgcattgcctggtggaactggccgctggagaaactgctggcgaatctgcccgattttcagaacggtgacatcgaagcgttctgccagcggcacggtgcatagccaccccacggcgccgtcagccggtttgtacgccgaaatagcgcacaacccgctggccatagagcccgacggccagtccggcgacgatcagcagcagcgcggcgattttctgaggtgaaaccgtttcgccaaatatcgccactgaacccaggatgccgaacaccggtaccagcagcgacagtggcgcgaccgttgaaaccggatagtgtttcagcagccagttccacacccagtagcccagcagggtattgggatagacctgaaacagtatcgacaacaccgccttcacatccagctgagtgaagagtgcgtgatagcccgcgctgccattgaccagcccgtccagcaggaagagtggaatgggtgcaaaggtgctcgaccagaccagaaaagcaaaaacctgccgggtgcccgcttttttattgatgatattggcaatactccatgcgaccgcgcctgccagcaccagcagcatgccggaaaacgtcaccgaaccatcggtaatgaaaaaaatgctcagcagaccggcgcaggccagcgcacaaccggcgatctgatagcggctgagacgctctttaaatacccagccaccgagcagcagcgtgaagaaggcgctgaactgcagcagcagcgaggcgatgcccgccgacagtccggttttaatccccagattcaccagaccccacaggccaatcccgaagaccaggccatagctgatcaggtagcgccacggcacgtccggtttcttaataaagaacaacgctggcagggcgcagagcgtaaagcggatacctgccaggataaacgggtcgaccgcctgcaggccgagcttgataactgaaaagttaaccccccagatggcggtgatcatgacggcgagcagcagatgcgttaatttcatgagtgacgaactccggaccagcagagaaaggcagaggcactgaccgctgcaccggcatagcagacagcctgccatccccagtgcgtataaagctgagtggcggcgatggcccccagcgcactgcccagcgagtaaaagcacatataggcacccaccagacgacttgccgcctcgggtcgggcgcccacgatcaggctctgattaatcacatgtaccgtctggacggcgaaatcgagcaggatcaccccgaaaatcagcaacagtaacgaggtgtgaagcgcggctatcggcagccaggagaaggtcagcaacgccagggctaagccagtggcacgctgccccaggcccaggtcagcccatgcacctgctctggaggccgccagcgcaccggcaagtccggccaggccgaacatcccgatctgggtgtgtgacagtgacaggccggtaagtggcagtaccatcgaagaccagagcatactgaaggccgcaaaaatcagcagcgccaggatcccgcgtctgcgcagctgcggttccgtgaggaagagacggaaaacagacaataagaggtgaggataagatgtgcgccgcgtctgacctgctgtggcgggcagcactttcgccaggatgagcgagatcaggagtaacaggcaggcagccgtcagatagaccgcccgccagcccgccaggtcagcaatcatcccggaaacaaaccgcgccagcaggatgccgatcacgatgccgctggtcacgctgcccaccacctgtccgcgctgttctggtgatgccagcatggcggcccacgccaccatcagctgcgtgaccaccgccattaatcccaccagcagcattgcacagagcagcgtcatcaggtctggcgcaaccgcagcagtgattaacgccagcacggaaaacagcaactgggtaatcaccagttttttgcggttaacgcagtcgcccagcggcaccagaaagaccagcccgagggcgtagccgctctgcgtagccgttaccactgtgccaatggtgccggtggaaacctgcaggctggcggcgatcgattccagcagaggctgtgccgagtaaacattggcgaccgccagcgcagaggtgagtgagaacaaaaagatcatccgggacgagagcaccgggatcgcggctgggggcgaatcggcttcaggatcacgcatcttgccaatcgtacaggtcatgttgctttcctttctggtttttatttgaaactggattggcgatatctttaaccgggctggtttttttttgcaacttcttttcggagtggctaaactgccatcatgagacaggcagcgtgagagaagagcatggctaagcaggaatccctgagaaccagcgagtgtccggtcgccagaaccctggagtcgataggtgagcgctggtgcatgatgatcgtgcgtgaagcctttgatgacgtccgcagattcagtgacttccagcggaatttggggctggcgaaaaatatcctggcgtcacgcctgaagcagctggtggagataggggtgtttgagattgcgcctgcctccgacggcagcgcctacagcgaatatgtcctgaccgaaagaggccgttcgctgtttccggttgtggtcgcgatgcgccagtggggcgagcgttacctgtttgagaagggcgaaacccactccgtgctgctggataatgcggaaggaaagccgctgccacgcctggaggttatctcttcacaggggcaaaaactggaaccggccgactgtcatcgtcagcgggtggtggctgaagggtaaccgtcagggtattttctcctctgcacactctgagactgacaggcctgacatcgcacgcgttacccgatcatcgctgtcgcctgtagcggtgatcgaccaaaatacctcactcccgttttacgccccgccgtaagggcgttatccccggaaacaggtccccgcgcttcctcatcctttcctgccccgcatcatgacaggcctgtcgatatcatcacattttccaatgaccggttgccttgtaacttcccgatgcgcatgacaatatcgctgcttgtatagacatgtactctcaaccctggattgggcaaatcacgctttcagtcaacacgtctctcactgttccagcgaggaatctatgtcggtcaaatcatctgtatcagattattcaggctcagagaaacagggcctgtcagaaacccgctccattgattacatcccgttgggtgaacgtcatggtcatccctttaaccagtttacgctctggtttggtggcaatctgcaaatcacggctattgtcacgggtgcgctggccgtggtgctgggtggagacgtcgtgtggtctcttatcggcttactggtggggcagattctgggtgcagcgatcatgtctttgcatgcgatccagggcccgcgccagggtttaccgcagatgatcaccagccgtatgcagtttggcgtgtttggtgctgttattcctctggtgctggtgtgcattatgtatgtgggattttcagccagcgggacagtattagccgggcaggcgctggctaaacttatccatgtcagtcattcaaccgggatgatcctgttcagcaccctcatcgtgatcattgcggtgctgggctatcgcgtgattcatcaactgggcaagctggcgagcgtcattggcgttttagcctttgcttatctgtttatcacgctgttctctgcgcatgacttatcagccgtgtggcagaatcagcactttaccccggcaaatttcctgctggcggtctccctgtcttcatcctggcaaattgccttctgtccttatgtctctgactattcacgctatctgccagctgatgtctctgcgaagaaactcttcagttcagtcttttttggcaccgtacttggcacgcaggcgtcaatgacgctgggggtgattgtcgctgccattgccggaagtgcgtttgcaggcaatgaggtcggttacatcgtgagcatgggtagcacggcgaccatggccatggtgatttatttcgccatttgctttggaaaaatcacgtttaccacgctgaacgcctacggcagttttatgtcactgaccaccattgtctctggcttccggcagaaaaccacgctgagtcggggtgggcgcattctgtttgtggtgcttatggttacgctggcctgcgtcattgctctgctcagtgaaccggcctttctgaaatccttcacccacttcctgctgtttctgctggctttctttgtgccgtggagcgcgatcagcctgaccgatttctatctgatcaccaggggcagggttgatgtcccggcactgtcgcagccggacgggcgctatggacgctggaacctggccggtattaccgtctattttctgggcgtgctggtgcaactgccgtttatcgataatccgctgcaccatggatcgctgacctggatttttgccggtaatgatgtctcgtggatcatcggctggtttgcgacggcactgttatggctgatcgccagccgctgggatcgtcggggcatccccgaacagtcaatttatcccgcccaataacaaggtcaggccgcctgagcggcagcctttcagggagtgtcactcttcgcgggtgtgtgatcacccgcgtgtcaggaaatcctcttttaagatcaggcggcagaaacgtccgctgcgccggtctgcgcctctgccaccagcggcttctccggttgcagcagtgtcattgccagcatactgccaaaggcgatcagcgcggtgacggtaaacatcgcgttgtagccgtaatattccgccagccagccgcagagcatcggagagataatcgctgccagattggctatcgccagcgtcatgccactgtaggtgcccaccgacgctttaggggtgacatcaatcaccaccgaccagtagacattgtttaccagtgcattcagcgcattgcccagggtcatcagtgcaataatccccgcagccgactgcacataggggatcgccataaagcagcaggcggtgccgcacagcgtgacggcggcaaacagattgcgcgccagacgcagattacggaagcgagccagcagggcatcggcaatgcgaccgcccagcagcaccgtgatacaggcgccgctccacgggatcatcgcgacgtaccacagtgagtgcaggtcgtaatggaaattatcctgcagatatttcggcatccaggtcaccagggtaaaggtgatgtagaggaatgagaagtagcccagcgcgttgcagaccagggtgcggctggtaaagaagcgccaccagggcagtggtacgctgtcgcccgcgctgcggcgctgaccggtctggataagctgacgttctgcggcattggtatgtggacttttctccgggctgtcgctgaaggtgcgggcaaacagcgccatcgccagcagggagaaaacaccgagcaggataaacatcatgcgccagtcatgggtcagcagcagcaggcccaccgcaatcggggcggtcagcagcgcgccaacctgggtcgagagcaggccgatgcccagtgcaaagccgcgctcattatcgggtgcccagtgagcaatcgccttgttcatcagcgcataggccgggccttcggaaaaaccaaacatgatgcgaagggcagcaaagcccataatggcggatccgccaaacagcgccatgcccagtttcccccgcccaggcggtggcgatctccagcagcgaccagagtacgcctgccagcagccagacttttttcgtgccgatacggtcggcaagaaagccgccacacagcgaaccaaacagatagccaaagccaaagtagcccagcacggctccgagctggactttgctgaagtgatactccgccgcaatggcgttagccgcaaacgacagggcgccgcgatcgatatagttgatcagggcgatcaggaacagcagtgaaaatatggtgtaacggtaacggctggttgtcatctcacttctcctgattaaatgtctcaggagagcagaagcaaaattgatgccggaaagggtatttatccggcaaaccgcggacaagcacagaattcgggcccctgagcccgctccgaagggggttaactgatcccgctaataattcgcctgcgcttcaatgcggtgcagccgctgcctgtcggtggtgaggctcaggcggcgttatgatggttggggctgacgtgtggcagcgggataaccacggcttccgtgactgcttctgtatcagccgtcccgacctggggtatttcgccaacgtgttgtaaaatctgctgctgataagtcgcatctgccaccgtagtctgttcactcagcagtacgcccgcctcattgacgttttttccgtccacttttattttgctggtggcactggccagcatccactcatattcaatatcgacgtggccgctatcaatacagcggataccgtgctgacttaaatcatatgccagcacggttgcggtcggccctaatgaaatcaagaccaggtcaaagttgacggcattctttaaaacggtatcaaacagacgatcatagacggaaaaggcattacggttcagcgtcgtaatacgtttcacttcgctggctccctccagtaaatcattgcctaatcccaggcgcgttccactgccttccacaattaatacccggcggccctgatagagctgtttaaacttatcaaatatcgtccgggataattgcttgcctttataatcgtgatagggacgggtcaccgaggtatttccatactggtactgtttattcagcaggccctcataatatttaaaataaaatgatttatggaagaaccagaacagggccgacccgccccgcatattacgggtggtacgaaaggcatccggcagacagatcagacagttcgggttggctcctgaatcctgctgcagcaaggctttgagtcgtgcagagagattcgggtcaaatggctggaaaccgatatttttataccaggtcatttccagctcaccgtcgccataacgggccagagataattgtgggttacgtaataacagatcgacagtctcttctatcgacatgacggaataacgctttacccgtgcctgcgcggcaggatagcgaatggcagcattaagaaacttaaaagggaaacgaaacttgcgataaatagcgtgaagtgcggtcatagttaacctgcctggttcattgctgccagaaaaatcccgcctgctggccggataaacgaatataagagagctgatatatatcacagataaaataagcgtcatgctacggaatatctgaaatcgttttcatcggcaaaatccctttgttcattaatctatttcctgcgaattcttttacaggaaataataaaaaacgcgttcaggctggcacaattaaatcatttaaacatcagcgacaccgcaccagcgttgatgaagccgccaataataacagcagggcagtaacattcccgatttcagcaataagagttatttcagagcagagttaataaaccattatgattatttgactctgaaaaactttcgtcgggcacactttagctggcgttacagaagggcggcttgtctgttaattaatcgcctttgaacaaaaggtgcggtcgttagcagcctatggttaattttttgtgatggatatcccgtaatcagcccttcagaaagtaaaaaaagcggcctgaccgcattaacaggtgacatttataataaatatttctaatgattaacgcttatacacgtttttacatatttcgtgcgtaagttaaaatctcgttgaatttatgtttccagcttaacctttcaattgccgctaatgacccgaggatggatcatgatcaataaaataaccagtataatcatggtgatatttgctatcgccctgatttacatgggaggacaactcctgcttgcaggaggcagcgcgttctatgcgctgatgggcgtgggcgttctgctcagcgcgattctgctgttgatgaacaaacgcagtgcgctgacgctttatgcgctgctgatgtggatcactctgttctggactatctgggaagtgggcttcgacaaatggcagtggattccgcgcggcgacctgtttggcgtgctgggtctctggctggcgctgccgtgggtggtgcgtccgctctatcaggggcagcgtcgtttccatcctttcctcgggggttccgtcgtcctgatggtgctgctggtcatcggtctctgcttctacgatccgctgccgcagcagggcgccattaatacgccgcgcaacgcctctgcgaccggcggtgccgctgaagagtggagcgcatatggcggaaccacagatggccagcgcttctcggcgctgaagcagatcactaaagataacgtgaaagatcttgaagtggcctggacctatcacaccggcgacctgcgtcagggtgatgatgcgaccgaatacacctttgaagcgacaccgctgaaagccaacggcatgctctacttctgtacgccgcacaacgaagtccatgctcttgacccggaaaccggtgcggtgaagtggaaaacgacgccggataaaaaccgctcttatctgcagcagcaccagacctgtcgtggcgtgagctacttcgatgccggtcagcaggcgcagacgggcgcatcgccggccatctgccgcaagcgtatcttcaatgccaccaccgatgcccgcctgctggcgctggatgccgataccggtaaagcctgtgctgactttggtgacaacggtgtggtgaatctgcgcgccaacatgggcgaggtgcgtccgcatgcgctgatgcagactgccgcgccactggtggcgggcaacctggtgattgtcggcggttcggtgatggataacggcttcaacagcggtaacccatcaggtgtgatccgtgcctatgatgccgtcagcggtcgtctggtgtggaacttcgatccggctaacccggataacaccgcaccggtcgctgaaggggcaacctatccgcaggataccccggtcgcctgggccaccctgagcgccgatctgaaaaacggcctggtctatgtgccgtttggtaacgcctcgccggatgaagtgggacttgaacgcgatcccgccagcaacactgaaaaattccgtgatgcgctggtggcactggatctgaaaaccggtgcgttcaaatggcgctatcagagttcaaaccatgacctctgggatcgtgataacccgtcacagccgtcgctggtggacatcaactatcagggcaaaccgcaaccggcggtgatcctgccgaccaaaaccggcaacctgtttgtgctgaaccgcctgaccggcgaaccggtttatccggtagagcaggttaaggtctccacggatggcattaaaggcgagcagtatgcggcgacccagccagtctccagcctgaacttcattccgcagccgctgactgagaagtcaatgtggggcattacgccgtttgaccagatggcctgccgcaccacgttccgtgagctgcgctatgacggtaacccgtggacgccaccaacggagaaaggctcgctgatcttcccgggcaacatcggggtgtttaactggggttcagtagcggttgatccacagcgtcagatgctgattgcggcaccggtgcgcctggcttacaaatacaacctcatcagacgcacgccggaaaccgaaacccagcgtaccttcaccaaagatggtacgccgtactggaatgagaacttccacggtgactacgctatccacatccagcagatggcgtcgggtctgggtattccctgcatcgcgccaccgtggggacggatggtcggtgtggatctgaccaccggcaaaaccgaatggctgcgtcgcgtcggcaccaccaaaaacctcaagaccagcttcctgcctggccgcttcccgctcggtttcccgatgggtatggtggcgcacggcggaccgctgctgacggcgggtgatctggtgttccacggcgcaacggcagataacttcttccgtgcttacgacagcaccaccggcgaactgctgtggcagactgaactgagcgcgggtgcgcaggccacgccatccacctttatgggcaaagatggcaagcagtatgtggtaattgccgcgggcggccacggctcgctcggcaccacggcgggcgacagcgttgtcgctttccgcctgaagtgattttttaaaaaaccgacccgctgagcgccgccctggcgctcagcttttttcacacctctacctgccagatctcacacccggcttagcgcgacaacctgttgtatttcatctcaattctttcatctccgcattcacatcatctgataacgcatcgaaaccatttcgtgacagcgctcccgctttaacgatttctcctgcctgacagacttgcgcattaagccgcgaggcgtagattaatatatgacttcacaattaatcgtgaatacgaaaagtacttcacaatacgcactctgaaggattgatgctcatgtcggaactgaaatttgctacccgtcttaactctttcgcctcgggggcgcacctctactggcccgatcagcagggcaagccctctgtgctgcagatggttgcccgtgcaggcaaggtcaaaggcttaacgcatctcgacctcaactttccgcaacatctcaccagcgatatccccacactgcgccaggcgatcagtgatgcgggtctggccgttaacggtatgcagatgcgctgggacgcgccacagttcaaaatcggcgcgtttacgcatcccgacgcgaaagtgcgtcgcgaagcgattgagctgaccaaacggggcattgacgcgggtcgggaatttggttcacggctgatgacgctgtggatggggcaggacggtttcgattactgcttccaggcggactataagaagatctgggaggatgcggtcagcgccgtgcgtgaagtggcggagtatgcaccggacgttgacgtcagcatcgaatataaacccaatgagccacgtgcctacagcatctttcccaacgccaccacctgtctgctggccgtggaagaggcgggctgcgccaacctggggatcacactggattttgctcatgtactgtttgccaatgagatcccggcttacgccgccgctatggtggcgcgccgatcacggctgctggggctggaccttaacgacggctggggcaagcgtgatgacggcctgatggtcggctcagtcaaccctcgcgccacgctggagtttctctggcagatgcagcgtgatggctaccgcggtgcctactacttcgataccttcccggatgccagcggtcttgacccgatccgtgaggcagaaagcaatattgcgaccgtgacccgtctgctgaggctgtgtgaccagctgcacgacaacgcggcgttactggcggccattgagcgtcaggatgcggtggcctctcagcagatcgtcaatgacatcatgctggcgcgctgacagccgattaatcataaaaacattacacctctacccaacaccctgagaataaaaaatgaaaaaacgcctgcttgctcttatcgcctcctcactgctctgcagcacggtttatgcggcagaaactggcaccgctgcaatccgatactgaaccggatcgcaccgactggacccagctcgacaccaaatatggcgcactgccaaaagtcgataagtcgctgaagattggcggggtatcgaaaaccctgaccaatgagtactggcgctcactcggccagggctaccagaacgcggcgaaaaagtatggtttcactgtcgcttatcaggcggcggccaatgaagacgatcagcttggtcagctctccattgcggaaaccctgatctcgcagggctttaacggcctgctggtttcgccgcagaccgatatcaacctggagcctgcactggagagtgccaacagtaaaaatatcccggtggtgaacgttaatgatgcggtgatgccgaatgcgcgctactacgtcggcaacgtccagaaggacaatggcgtgcgggtggcgaaatggtttattcagcaccatccgcagggcggcaacgtggcggtgattgaagggcagccaggggtttatgccgccgggcagcgtacccgtggctttaaagagacgctggacagcgccgggaagttcaccatcgtggccagcgtgcccgctaactggagtcgcgagcaggcctttaacgccgcatcgaccattctgcagcagcatcctgatttgatcggcttctacgccaacaacgacaccatggcgctgggcgtggtggaggcggtacgcgcgcagaacaaagcatcacaggtggccatctttggcactgacggtatttccgatgcctacgcctcgattaagcgcggcgagctgaccggcacggtcgacagtttcccggtgctgaccggtgaagtggcgatggacgtcattatccgtctgatcaacggacagaaactgtcgcgcgttgtctcgacacctcaggcgctgatcacaaaagagaatgttgaggcgttctcaaccaaagacaacaaccggttgcgtcagctgctggctcaacaataggtcagcgggagcgggtatggaacagtttcgcttaatgatgcgtggcatcagcaaaagttacggtaacgccgccgcgctgcaggatgtcgatttctcagtgcggcccggcgaggtgcacgcgctgattggggaaaatggcgcgggtaagtcgacgctgctgaatatcctctccggcgttcgcggcgcggacagcggagagatcagcgtcaatggaaaccgggtgcagatccgcagtccgctcagcgcccgtcaggccgggatcgcgatgatccaccaggagttacagcatgtgcctgagctttccgtggcgcagaacatgtttctgggtcgcccgctgacccgcgccgggggctggtgggtggataaaaaggcccagctggcgcgggccaccctgattctgaagacgctggatcccactatcgatcccgatacgccgatcaggaacctcaaggtatcgcagcagcagatcgttgagattgcccgggcgctgctggatgacgccaaaatcatcgccatggatgagccgacctccagcctgacgccacgcgaatttgaccggctggcagagctgattggcgatctgaagtcgaccggcgtctcgctgatctatgtttcgcacaagatgaatgagattttccgggtctgcgaccgcgccaccattatgcgtgacggaaagcaggtgggggtggtcaacatcagtgatgaggatgaggagagcatcgtcgccaaaatggttggacggaagatcgacaagcttgaccatcaggcgtttgtcaccgatcgcgaagtgctgcgggtagaggatctgacgcgtggcaatgaggtggtggcggcaaacttcagcgttcgtgcgggcgaagtgctgggcattgccgggctggtcggcgcggggcgcaccgaactgctgaagctgattgccggtatcgacaggcgcacccgtggcacggtgagcgtcaacggtgccgcggtgaagaaccacaacgtgcgtgcggcgatcaaggcgggcattggcctggtaccagaagaccgcaaaaaagagggcattatcaaagagcgggcggtgaagatgaatatggcgctgccgtcgatgcaccgcttcacgtcggcggggctgatgaaccaggccaggctggaccgcgaggcgctgaaggtcatgggcgacctgaaactgcgcccgctcgacattgagaaaaccatcggcacgctgagcggcggcaatcagcaaaaagtgatcatcggccgctgggttgcggcggatgccaatgtgtttctgtttgatgaaccgacgcgcggtatcgatattggtgccaagtctgaaatctatcacctgattgaaaaactggcccaggcgggcaaagccattgtggtggtgtcgtcagaaatgaccgagatcatgcgcatctccgatcgggtgctggtgatgcgcgagggccggataaccaaagagttaaccggcagcgcgatcaccgaagagaacattgcccgttatgccatcaaagatatcgaccagaccgcctgaccgcttacctgacactatttaaggttataactatgacaactcagacatctaccgggccgggtacccgacctgcgctgcggcttaaatttaatctgcgtgatgccggtaccttaattggcttactgattatcgtggtgacattttcgtttctgtcgccggtctttttcacgctgcctaatctgctgaatattctgcagcagtcctcaatcaacgccctgattgcactgggcatgacgctggtgattatctccggcgggattgacctctcggtcggtcccacggcggcgctctctgcggtgctgggtgcaaccctgatggcatcgggcgtgccggtgccgctggcgatccttgcgacgctgggtgtgggcgcgatgtgcgggctgttcagcggcacgctgatcgcctatgccgggctgcagccgtttattgtcacgctgggcggcctgtcgctgttccgggccattgcgctgatctacaccggcggcaatcccatctttggtattccgctggaatttcgcagcctgatcaacagtacgcttttcggtatccccacgccgattgtgattgtggcagtgattgcactgctgctgtggacggtgatgaataagaccccgctgggggaatatattctggcgattggcggcaatgaagaggcggcgcgggtcgcgggtgtgccggttaagcgcaccaaggtcacggtctatatcttctccggcctgcttgcctcactggcctcgctgattctgattggtcgtctgggggctgccgaaccgaccatcggcaacctgtgggaactggatgcgattgcggcggcggctattggcggtgcgtcgttaatgggcggcaagggcagtatcttcgggacgctgatcggcgtggttatcctcggtgcattacgtaatggcttgaccttactgaacattcaggccttttaccaattgctcgctaccggccttattattatcatagcgatgttgattgaccgggcgacccgaggcaagtaatgaagcaagatccgcgagccattggcgctcagattcgtatgcgtttgccccagctgacgccgttagaacgtcgggtagctgaggcgataattgcccgaaaccgacattaccgagcaatcctcattaaaggagattgcgcgggagaataatgtctctgaagcgatgatcgttaagattaccaaaaaacttaacttcaccggcttcaggcatttcagaagtggcctgatctattacaaccagtctgaagtggcagggctgcatgcggaaattgagccggatgattcgtcggagcagttgctggccaaagttttcagaacctctatccaggcgattgaagagaccttatcgattctggatgtttctgaattcaatcgtgcggcggacattatctttaaagcgcgtcatatcgatctttacgccgtgggcggttctgccgccgtggcgcgggacctgtcacacaagatgctgaagattggcattaagtcgacagcctatgacgacgcccacatcatgctgatgtcagccgccgtgttatctgatgacgatgtggttatcgccatcagccattcgggtgctacgcgcgcggtgaatgatccggtcagactggcggggaggaatggcgcgaaagttatcgccattaccaactacgccgaatccccgatcgcgaagagtgcgcatgtggtcctcaattcaacctctcagggatcgcatctgctgggtgaaaacgccgcgtcacgcatcgcccagctcaatattctggatgcgctgtttgtcgctatcgccaagaaagatctgaagcgggcggagaagaacctgatgaaaacccagcatgcggttcaggatctgcgggaattctagctatgagcaaaattgcagtcaccggcagtcttcactacgacattatgctggatgcacaccatcgcccggaaaaaggcgaaacggtgatgggcagcgcctgtcactataagtttggtggcaaggggggtaatcaggctgtcgcagcggcacgcgcgggtgccgcagtgcgcttcgccggttcagtggggcgcgatcagcaggggcaattcctgctggatcatctgcagcaggccggggtcgattgcaccgccgtcagcatcattgatgcgcttccctccgggatgagcgtggcgattaccgatgccgaaggagattacggtgcggtggtggtctccaatgctaatcagcagatcccgctggagacctttgagcagcccggcttctggcaggcggtgtcgctgctggtgctgcaaaatgaagtcccggaagcggtgaacctctgtgcggcccaggcggcacagcagcgggggattacggtctgcgtcaacgccgcgcccgcccggccgttgtcagccgcgtttgaaaactgtattgatctgctggtggtgaacgccattgaagcgcgcgatatgtgcgggattagcgtgcaggatctgacgtcggcgcgctcagcggcggaatcgctggccagccggtttgccagagtggtggttaccgctggtgaacatggtgtggcttacagcgaggcgggagagacgcaaacactggcggcgcagaaggtgacactggtgagcacccacggtgccggggattgttttgtcggcgtgttgtgtcagagcctgagtagcggggtaacgctggcagaagcggtgagtgcggcaaatcgtgcagcagccgagcacgtttcccggcagccgcactgattaatggcgtgccacgtcagtgacgcggcacgctaacgtcgtcaggcaccgacgttcaccacggttttaccgaagtttttgccattcagcatatcgataaacgcctgtggcgcgtttctctaatccttcaatcatgtgctcgcgatagtggatttttttgttctccaccagcggacgcatcgcctccaggaactcagggtaacggtcaccataatcctggaagatgataaagccctgcatacggatacggcgtttcagaatgcccgccatgatcagagaggttctgtccgggccttgcggcagctcacgctggctgtaagccgagaccagaccacagaccggcacgcgcgcagcggtgttcagcagcgggaacacggcatcaaacactttgccaccgacgttttcgaagtagatatcgatgccatccgggcaggcatttttcagctgctcttcaaagtcggcgctgtggtgatcgaggcaggcatcaaagcccagcgtatcgaccgcgtaacggcatttctcttcaccgcccgccacaccaacgacacggcagcctttctgtttacccagctggccgaccgttgcgcccaccggaccggttgcggcggcaacgaccagggtttcacccgcttttggctgaccaatatccatcagacccatataggcggtaaagcctggcataccgagaatacccagcgcccatgagggatggggcagatcgttgcccagcttcgcaatctctttgccatcggagacggcatattcctgccagccgctctgcgccagcacccagtcacctgtcttaaagtcgctgtttttcgagtcggcgacctgacagacggtgccgcccaccatcggctgatccagctctgccggcgcggcgtaggatttaccctcgtccatccgcccacgcatgtaggggtcaagcgagagatagatggttttcagcagtacttcaccctctttgatttccgggacgggctgcgccacatggcggaaattctctttggtcggctcaccgtgagggcgtgaagccagtaaccaggcatggttctgggttgcttgttcagtcatattgtcatccttttatagccgggcaatgctcagggcatcaccatatgaataccgggaaagtgtagatgaccacggcgggaatgcgtttagcgctgtgagcggtaagctgatttaccgataacagggcataaggtgctaaccacggggacacagcggatgcaggaccattcgcgtcacggattcagtctgacggctgttcacatccgcttgcaaaaaacgggcaggcgggtcatcagcagtgcggcatgccacgcatccaggtcagagggaggcgactatcattacgcttcaccacaagacttacagggccagggcatattttgcgattgccgaaacagagaagctaaaacgcttctagaccgggttttacagcatccgccccgtgatgtaatgtatgaagtgaataccgccataggcgaagaaggaagaggttatgtactcaaaacacgatatttcaaccctgaaaaaaatgacagttgcagagcgtaaagcggaagcaatgcgtcagctcaaagaatcttttgatcttgcggagcgctcaggcacagtgcgttcacgcgaagcaaaggctggttgactgtcagcttcctccaaaacccgctaaggcgggtttttttatgccttcaatttatgggcatgggaagttgctgcgcatccggcgtcacgggaagctctgaagattgtgataaatatcagtgaactctacagggagagaaccatgattatccagcatctgcgtattgcccgaccggtgacagacctgacgcaaagcagtcagaactattgtgacgggctggggttgcaagaaatcggtgagtttactgatcatcaggggttcagtggcgtgatgctgggcgctgaagggctggcctggcatctcgaattcacgctctgtcacacgcatcccgtccggccatcgccaacagatgaggacctgctggtgctctacattccgcaacggcctgactggctgggccgatgtgcctgtatggatgaggcaggatttatgcggttgaattcatttaatccctattgggaccaacggggcgtgacatttatcgacagggatggttatcgtgttgttatccagcatgcagcctggcaatccgcaatctgacctgtaccggagttcaccctgaacattctttgctttcacacagcagccagtaatatcgcgatatttgatgatgccgcccgcgcactggcgcgtgacaatccgccgctgaatcatctggtgatgcctgcgctgctggcagaagcggaatgcagcggcgggatgacgactgcgttacgccgccgtattgcccaaatgattgaaacgctgctgccgcagttcgatgcggtactgatcacctgctcgacgctgggccccgttgccggtgatttcagcgcgcaggatcgggttatacgcaccgacgaaatgctagcggaggcgctgcagcgtcaggcagggcgcacagtcgcgctctgtgcggcagaatcaacgctggcggcgacgcgggcacttttctgtcagcccggcagccaggtggaggtcgcgctggtggagggagcgtggacggcgtttaaagcgggggagacaacacgctattttgcaatgattgcagcagcagcagagcaggcttatcagcagggagccgttgcggtggccctggcgcaaagctcaatgacgcccgtagcacagcagtttcctgtcaaacagcgaccattgaccggcccgtatcttgcgctgcaggcctgctacgaactcagatgaccgtcacaccctgctggctcagtgcctgtcgcagcgcctcgtccggctgcgtttccacgaccagcgtgctggccagcgacaggtcgccaatggcaaatgccgaggcggagttcagcttttccgctgacgccagcaccacggtttccgctgcgcgtcctgccagcgcacgcttgaccgtcgcctcttcgaaattaccggtggtcaggcccgccgccggatgcacgccggtgacgcccataaaaaagagatcggcattgatgcggttgatcgactccagcatcgctgcgcccaccgtcaccactgaatgtttatagagctgcccgccaatcagtatgatctccacgagtggatgatcggctaacgccagcgccacgctgggactgtgcgtaaccgcggtaaagctcagcgtggcgggtaaccgtcgcaccagtttccgcgctggtggtcccgccatcaatcagtacgatctgtcccggctggatcagtgaaacggctttttgcgcaataacctgtttggaagcagtctgcacgcttttgcgcgtttcaaaggtggccagcgcagcggaaaccggcagcgcgccgccatgtacccgctgcaacaatccttcagccgccagttcacgcaggtcgcggcggatagagtcttcagagaggccaaagcgctggctgagatcgcgcgactgcacctgtttttcctgggcgagcagggcgagaatcgtctgttttcgctggctggatagcatgactggcctttgcatgttttttcttgaagttgcacgattgtgcatgatagcgtgatggctgtctactatcctggagagcatcatgcagcagaaccatccccgcgtgcgcatcatcaatgagcagttgctgtcagacaactggtataccctgaagaaatatacgttctcgctgctgcgccgtgacggtcgctggcaggagcagagccgtgaagcctatgaccgcggtaatggcgcagtgatcctgctctacaaccgtgacaaacgtacggtggtactgacccgtcagtttcgctttccgattttcctgaacgggcatgatggctttctgattgaagcagccgccggtctgctggataacgcctcgccggaagcgcgtattgttgccgaagccgaagaggaaaccggttttcgtgtcagccatgtgcagaaggtgtttgaagcctttatgagccccggttcggttactgaaaaactctacttttttattgccgagtatggcgatcagcagcgtagcggtgaaggcggcggaatagcggaagagggtgaggatattgaggtgcttgagctcggttttgaccaggcgttaaaggcgattgaccagggtgagattgtggatgccaagaccatcatgctgctgcagcatctgcggctgaaaggcattttataagagaaacgggcagaccgccgttaatacggtctgcccgttaaagcttactgatcctgcgtcaggatgccttttacatcgtgcggttcagaacgcagatactgtggcggaacctggactttaccatccagcgcagcggctgcgtgccacggccagcgcggatcgtaaagaataccgcgcgccagcgccaccaggtcagcttcaccctgttgcagcagatcttctgcctgctgcggctcagtaattaagccgaccgcaatcaccggaatcgacacctgctcacgaatatcgcgggcgaacggcacctgatagttgggtccgacgctgattttctggtcttctgacaaaccaccacttgagacatgaatataagcactgttcagcgcttccagctcacgcgagaaggcgattgactgattgatctcccagccgccttcaacccagtcagtggcagaaatgcgcacgcctaccggcacggaagcgggtacggcatcgcgaacggctttgaagacttccagtgggaagcgcatacggttttccagcgagccgccatattcatcactgcgctgattcgacagcggcgacaggaactgatgcagcaggtagccgtgtgcggcatgcacttcgatgagctgaattcccagacgcaccgcacgcagggcgctgtcgacaaaggcctgttttaccctcgccagatcgtcagtgttcatggcaaccggtttcacttcatccgcgctgtagctcagtgcggacggagccacggtttgccagccgccggcttcaggcgcaatctgcttaccgccttcccagggtacggcacacgacgctttgcgtcccgcatggcccagctgaataccaaccggaatagaggagtagcggcggacatcttccagaaccgttttcagcgcagcttcattatcatcattccacaaaccgagatcgcctggggagatgcgaccaatatcctctacggcggtggcttcaatgatcatcagacctgcgccggaaaaggccaactggccaagatggatacggtgccaggcggtcgcattgcccgcctcagcggagtactggcacatcggcgcaatcacaatgcggttatccagcgtaagttcgcccagcgagacagtggaaaaaagttggctcatgttatctccatggtttttatgactgacgtgacaggcaataactatagcgggggatttgccaggcgggtgtttcttcaacgtgacattttatgacggcgtgccggattcaggttaaagatcaacgcagccggatgtctcaggcaggcattgatacgttaacggttcagcctggcgcgctttgctgctcacgcccggcgaaccgggattctacgtaacggataatgacaatcaccagggtctgatattcagctacagggtgactctcagacctgtgccattccgccatcaacaaacagttctgccgcattgataaagctggcggcatccgaggccagaaacgcaacggtgcgggcaacctcctgcggctcacccaggcggccaagcggtatctgtgttgccagcgcatcaaacaagccctgacgctgatcttcactgaccagatcacccagcccaggcgtacggacagggccggggctcacgacattgacccggattccgcgatctttcagatccagcgcccacgaacgggcaaaattgcgcactgccgctttactggcgctgtagacgctaaaagccgcagtaccctgcgctccggcagtcgatccggtcagaattaccgatgcgccatcaaccagcagaggcagggctttctgtacggtaaacagcacgccgcgtacgttagtgccaaagatacggtcaaaatgctcttcagtaatcgcccccagcggcagcatgtcgccgcccccggcgttggcaaagagaatatcgaggcgtcccgcctgcgctgcaattctcgagtaaacctcatcgagatcgtgcagttgtgaggcgtctgcgcggatgccgctgacggttccgccgatttcagcgacggcggcatccagctccgcctgacgacggccggttataaaaacctgtgcgccctgtgccgccagctcccgggcggtagccaggccaattccgcttgttccgcccgtaaccagtgcaatttttcctgcgagtgatgcgttcataagttcttctccggatagtctcatagacagattggttattcccggtcagcggggctgccggactgattgctactgtaagagaggaggattggcggataaatccgctaaaatgaaaatgactatccacatgggtggataatagggggatagaatggatcagctgctggcgataaaagccttttcacgggtggtggaaagcggcagttttacccgggcggcggactcgctgaatatgccgaaggcgacgctgagtaagctggttcaggagctggaggcgcatctttccgtcaggctactgcagcgcaccacccggcgcgtgaccgtcaccgcagaagggcgtgaatactatgagaaagcgctgcgcatcctgcacgatctcgaggatattgatgcctgtttcaattcactgcgcagtaagccgcgtgggcagttacgcatcgatgtcggcggatctaccgccagggacgttctgattccgctgctgcctgatttctttgcccgctatcctgatattacgctggatctgggcgtatccgatcgcccggtcaatcttattagcgacaacgttgattgtgtgatccgcggcggtccgctggtcgattcctcactgattgcccgcctgatagggcacgctacgctcattacctgcgcgacacccgcctaccttaaagcgtttggtgtgcccgcctatcctgatgaactgcgcaacggacaccggctggtgagttatctctcgccgcaaaccggcaagccatttccgcttcggttcgaacgtcagggagagaaaattgagatcaccagtgcgcatcgcattggcgtcaatgaaagcaacgcgcatctggccgcgggactggcagggcttgggatcattcagacatttaattattcgctgtcgtcaattctgcggcagggagaaatggttgagatcctgcacgactggcatccggcgggttatccgtttcatctggtttatccgcaaaaccggcacgtaacgcaacggctacgggtatttatcgactggctggtggagtgctttccggcgcgggtagcgggagaggggaaatccggcacctgagtgccggatcgggatcagttgccgcgataggtagagtaaccaaacgggctcagcagcaacgggatatggtagtgctcaccgctggcttccatgttgaactcaaccgggatctccgggaagaaggttttctggttgttctttttatagaagtcaccggttttaaacaccacgcggtagctacccgcactggctgttttgtcctgcgggaacagggcgctgatgcgaccattgttatcggtgacgcctgacgccagtttcacccagttatcctgctgcttctgatccagttcaacttcgatgcctgccgttggctggccagtttgaaggttaagaacgtgcacgctcagtgggtttttagcggtagcaggctgagctgcaatagcggatgcgccagaggtcatcagtaatgttgcgatcaaggcatatgaagttttcatcaatgtttcctttattgattgtctgaagtcgggtgacagtgcagagagagtaatgcgcctgagggcaaagagatatttagccgcaggaaatgtgaaatttctgagaaagaaggaaaatgtctttagttacatcatacagtgtttctgcttaatcatagtccagcacctgtgcagtcatagctaatcagggaacagaggcaccagatgaaatcctctctgaattcagcaataaaacaaagcctggcccctggcgggcaacgtagcgatagcaatcctctgatctatccacagaatcgtctcgtcagttatcaactgccgtatatgtgtcgactcgcgggcgggctgttttctggcgcgaatggcgtgagaaagtgaatccggcacacctgatcagcgagccggattcgtaaaaaagtctgaccgtgacagggtgtgtaaccgaacggactcagcagcggcagcgggatagggtagcgagcaccgttggcgtccatgctgaacttaaccagaaaaaaactctatgcttttaactttttcaggtgctcaggcgtcgtgcttaattgctgaaaataggtacaaatagtcagagagggtaaaagcatgatataaatagtgtgctatttagtagtttacaatccaggttcgccgtgtcattgtcctgccaaccagatagcacactacttaatagcaagttaattggaaccctgtgatgaaaatgaaactgatcgccagtgcattattgttagccagccagatgagtaccgcgtttgctgcacccactgaaaacagtccgcaaccgaccgcagacgtggccgctttcctgaaggcgctcaacagcggtagtggtaaaccgattgagcaactctccgtcaaagatgcccgagcggtgttgacgggggcgcagaagggcgcagaactgccgccggcacagatttcacagaagatcatcaccgtacagggcaagcctctgacgctgaccatcgttaagcccgagcatgccagcagcaccttgccggtgtttatgttcttccacggcggtggctgggtgctgggcgattttccgacccatgagcgactggtacgtgacatggtgaatgcatccggcgctgctgcggtatttgtcaattatcaaccatcgccagaagcccatttcccggtggcaattactcaggcttatgacgccactaaatgggtcgccgaacatggcgctgaaattggcgttgacggaaaacgtctggcgctggttggtaatagcgttggcggtaacatggtggcggcggttgccttgcaggcgaagcagtttaaaacgccggccatccgttatgatgtgatgctgtggccggttaccgatgcgcgtttcgacaccgcgtcgtatgatcaatttgctgacggacatttcctgacgaagaacatgatgaagtggttctgggataactataccgtttcggaaaaagatcgtaataacatcctggcatcaccgttgcgtgccaccactgaacagctgaaggggctgccgccaacattgattcagactgcagagctggatgtgttacgtgatgaaggtgaagcgtttcggtcgtaagctggatgcagcaggcgtgccggttaccgtgacgcgttacaatggcatgattcatgattacggtttgctgaacgcgttaagtcaggaacccacggtcagaacagctattaatcaggcgggtgaagagttgcgttcgcatctcaaataactgaccggtcatgaaaccaaccccggaccgaatcgtcgtccggggttcttatcgggcagtaagtttgaaggaatcagttctaagacgcagggcagtgcgattgccggaacaccaggaaagaacggagcagtatccagccgataagtgcgctgttaatatctaatttaacataatatacattatgcgcatattgattatgatcgggagcgtgatgctctattgtatggtctgctcaccattttgggctgatcctgactgttttactctttacagcaaaatctgtcagaaacgatcacaatgtctgcctgaccttgttactgtcgcttattctgttccgaaactgaaataatgtgatgctacgttattcagcatggctttccctgcgggacatcttcttcagcgactctacacgctatcctctcatcaacaaacctgatatcggagatttgcagccggacgatgcaatgacgacttcgccctttgcggctggctggatgcactgctgcgcattctgaccgtttctctgctcaggtgctttgcacaacttaagcagtgacgtcgctacgtgaaaattagcgcattcatcagggctgtcggccacaaaaatgctgtagaggcgtctatgcatcaccgctttatgttcatcctcgttgtctgccgtgcgtaccactaaattgtcgtaaacgcgtccacgtgtaactacgctttcttcactctgtttccttgccaggttaatcctgtaatgagcaagaaagcctgagtcagctttctgctggctgtctggtcagccggactcataccggctattcgcattgcgattgcaaggcagtcaacgcagcgcagtgatgcttttgccctgagcattgaaaataagagtcagtaacatccggtcgttttcagcactatcagcgacacgcaaaatgaggtgtaacgtccctgctctgtcctgtcatccaataactatcttgtataatctgacaaaaaagcagaacgtaaatttcgcacagcaagaatgattcttcgtatacaaaatctgaatgataacgcccgggaaagaaataaatatagatctcttttcttttaatgacactgaccaaaatagtgatgtttccatgcactaaataactgatttagatcaatatttatagcaagtgcgtcaattaacatctttgttaccaggagtattcttaataaaatgggatgtgaactataaatatcgtcgctaatttttttataaaagccatttaaaatgcagatcgtttcaatgaagtaagggagaaagcaataatagagtcagtaaaaagtcatttatcaatgccatcttagtggccgctgtatacaaaattgatcactgaacaaaattcgctcatatttagcattgagtgcggaatttttattgatcaaagtggcgttatttgcgaaatattcctaacggacgtaaaaaaatcctggtctctcagcactgctgagggcgtcgtcgccctttttgtcccgaattttcaacaaatattactcccgcccgtggaggtgaccccttaagaaaaatccgaatgaagaaaatagcggataattttcatcgccttgaaacgcggagatttttatcgataaaataatcacaactctcgcaacaacgccaaaatattatgataaagataaccagagaggaaattcgctgcgccagttgtaaatatggctgtgatctcacccatcgcgcatcagacatttataacagatgtccgttgcaaaaaattaccacctggcctggagggaatcattttttctcttcatccatactcagcatggtcgctggaaaatatgagagcctcttttgcagaggatgtgtattcgttgacttctccagggaaaatgtcaggtattttaccaatagcaactggattgagtatttgaaacatacgggattaatgctgattatcgtcagtgatcgccatatggagccgcttgcggcgtactggcaaaaagaggacctgcgtatacaaactgtgatttatgccgatttttccctggaggagataaacagacaaatccagggctgttatttcggtttaaaaggcgaggtcaggaaaaaagtgaatgcacttaaacaggatgaagttcggttccttgatctggcgatgaacggactgtcactaccgattattgccagagaaatgggagttgaagtcaagcgtgtttataacatcaaagatgccattcgccggaaaatgggcatcagcctcaatcagttattttccgcataattatgataaaggagtattaaatgaacaccaaattcagaacgcttaatcttgctgtgttaatcagtgccgggctggtgtcagccagcgtgtttgcagcttcagataacaccatcaactttcagggagaagtgaccactgaaacctgttctgtttccgtaaatggcaacaatgcgtcccctgtcgtgctgctgccaacggtcagtactacggaccttgctgcctctggtgcaactgcgggtgataccaccttcaccgtgggcgttagcggctgcgccggggacagtacctcggccaccaaaatctcgacggtgtttgtggggaataacgttagcgctgccggtaatttatctaacaccggaaccgcaaaaaatgttgaggtacaaatcctcgatccgaaagatgcggtggttaatctgaccagtggttataccggcagcggtgatctgacactgcagaccggtgaaacttctggctctgccacctactctgcccgttattacgcatccggcacgccaacggcgggtaccgttaccgcatcactgcaatatgccgtgacttaccagtaatatttttcgtgcgtatctggatagccagatacgcacaccacgcttgagatatccgacatgtattcgcgcattatgctgttcccattaaaaatggtaatactgatttttttgatgacgtttatttcggataacgtccaggcaagcgtcactattcttggcagccgaattatttatccgggtaatgctctctccgtcgatgttcagttaaagaacaacgataatattccttatgtcattcaggcctggcttgataatggcaatatggattcgcaacctggcgataagagtgacgtgccttttattatcacgccaccgctgtttcggatccagcctctgaccggccaggttttaagaatccgattcatacctaatgtctcattaccacaggatcgcgagacgatttactggttcaactccctgcagatcccccccggtaatattcaggcggaatcaggccgtaacagtattgttttaatgttacgtaaccgcatgaaactcttttatcgtcctaaagcgattggtcagccggttaatgttttcgacggtgtaaaagtaacgatgcaaaaagagggggttgaaatcaacaacactcaaccctggtatctctcacttacagaggttgtaataaaaacagcaggcaaaaaaatagcctgcgaagccgaaatgattgcaccctttgccaaaaaaatagtcaggtgtaaaccggcaacgcactctttatcagctaatagcgtgatttctctttcagcaatgaatgaccagggagctaaagtcagtgaagactatccgattgcaggcaggtaatatccgcatcttttttttgcctctctgtgcatcatttactttttcaccgtatggacacgctgatgaatactacttcgatccttcgctgtttaaaggttccgcctttggccagaatattgatcagtttaaccatcagactatcgcccccggcaactattatgtcgatatctatgttaacaataagctggttaaaagcggcgtcaccctgaactttctgtcagcagagaaaggtcagccgatagaaccttgtctcccgctgacggtggctgaatcattaagccttaagtcactgaataaatcctcaaccagcgagggctgtcagcccttgcgtcactggtcatcagcggcccgctggcaatttgatcaggcttcactgcggctgcagttcaccattccggatgcggagttaattcatctgcccaggggaaatattcccgtcgccgaatgggataatgggatctccgcccttttcatccggcataacaccaattatagctggacggaaaatagcgcttccggttacagataccagtatttctggagtggcatcacggcgggcactaatattgataactggcagctgcgccatcagggcaatctgcggtttatcgacaataacgttaccggcagcgatgttcgctacacaacggtcagaaacctggcttcagcgccccattgaaccgctgaacagtctgctgacactgggcgacagctatacagaaagttcgcagtttggcagcctttcttataatggcattaagctcactaccgatgaaaggatgcgtccgcaaagccggcgtggttatgcgcccgaaattcgcggtgtggcctcctccagtgcccgggttatcgtcaggcaactgaatcgcgttatttatgagaccagcgtggcgcctggtcccttcgtgatcaacgatttgtacaatacccgtagccagggcgatctcgatgttgagattattgaagccaatggcaaaacgtcctcgtttaccgttccttatgcctctgtgcctgattcggtcaggccgggaaactggcattactcggttgcactgggtcgggtacggcaattctactcagttaataacaccttcttcgaagggctgttgcagcgcggtatcagtaaccgactgaccgctacggcaggatcgcggctggctcaggactatcaggcctggctgcttggcggtgtctggacttcggcagcgggcgcagtgggattaaacaccaccttttctgatgcaaaggtcgcacagaacagaaatgcctcgggatggcgcgccgagctgagctacagcaaaacctttgctaccggcaccaacctggtcctggccgcctatcgttactcaaccagcggttatcgcgacctgcaggatgtgctgggcgttcggcgccagcaggacaatggcatcagttactattcagatacgctgcatcagcgtaataatttttctgtgaccctgagtcagtcaatggccgattatggcttaatcagcctgagcggcagcacggcggattactataataaccggtcacgtattactcagcttcagttaggttacagcaacagctggaataacatcagttacagtctcaacgttgcccgtcagcgtactacctggaattatgatcgtttcgggctgaacctggacgatggtgataacgcataccgcgagaaatataccgaaaataccgtttcactgaatgtctcggttccgctgaaactggggcaatcacactacctctgtggcctataactacaaccagtctaaagaaacgcgcaattcgacgctctcactgaccggttcatctggcgagaacaatcagcgatcctggtccctgtatggcggaaccgaaaatacgcaaagtaacagcggccaccgtgtctcgttcggcggaaatattcagcagaatacgcgcgcaggcgcggtcagagcgaattatggtcaggggggtaattatcgccaggctggattagggctttctggtacgttgctgattcatcgcggcggcgtcaccgccggaccttataccagcgacacttttgcgcttatccatgcggatggtgcccagggcgccagcgtacgcaatggtcagggtgccgtcattgatcattttggttacgctatcctgccgtcgctgacgccatatcaggccaacaccgtcagccttgatacacgctatatgaatgctgatgccgaattaagcggtggaagccagcgcgttgtgccctatgccggttccgttacccgaattaattttgccacgctgcagggtaaggccgtcttaatcgcgctcaaaaatgaagatcatgaaatcccgccaatgggcaccgaggtccgtgatgctgataataccgtgataggtattgtgggccagggtggtcaattatatgcacgtgtaccgcatgactctggaaccttaaaggtaaactgggaatataagggcaataaaacatgttttgttaattatcaaataaccggtcgcgtgaatgagaatattgttcgcctggatgctgtctgccataagggttaatcgtgtgagaatcgaaaaatatttcctgtatatcttattattgctgttcaatgtgcccgcctgggctaattgcagtgttgttaccgccacatcctcgttgtctcaaagcgcgattgcagcaggctataccgccgcctactggaccggcgcctgcgacacctgctcagggaatgtgggcctgccatctgtgatcagcatcaatagcggaaagaccttccagccctctggcacactgctggccagctcggtaggcagctttctgtcatcggccagcaatgtttcctactcagctaaccagattctttaccgctgcgccgtggcagatgcagacagtttgtatgagatgtatgccaccaatggcgacagcccctatgccggtcaatatattacctctgaagtggacggcgcctattatgatgtcgctgcaaatgttgccgtcaggctaactaacctgacaaccggcgaatattacagtcgctactggaaagcccgacagctgacagccagtgactggtattctgatggcacctatatttatattccggccagtgctttcagcaatgtgctgtatgaaatgtttaaaatagactctacgcgctattacgccagcaacagcaatcgctatgtggacaactggacacaacctcgcggatatattgcttttaaaggacccgggctggataccaataatctgaaagtgggccaggatagtctctcttactggtatggtttttaccgtaactggcccgctgcctggagcaccttctcaaatgtcacctatgtgcgtggcgcgctatgcgaagtccaggattatccttcggtggtgctgctgcctaccgtaagcgtgaatacccttgccgcgggcgggaaaagtcaggctccttttactatcactatccagtgcgagtccggtgccatctccggcaccagtacatcgacgatcacgtcagcaaatgtcgctatgggctttctcgttaaccagtcaaatgcggtaacgcaggcaagaaatctggggctgactacagctggcggcgggttaacctggctgctggatacccactatggtagcagcgctgccgcctccggcgtcggtataaaaatttatgacagtcataatatggcgctcaatttactgcctgacagaacagtgacgggcacgggcaacagccgtggctggtatgcctataaagatttaacgtcgcaaatctcctcaggaggcgctgatatttacagtggtgatttcaccgcctctcttgaagcgctcagcgggcaaactattacagcaggaacagtcaatgcgcagttacaggttgtggtcagttttcagtaacgtcgttgtgttatctggcgtcctgctctcattcagcgtctgggcggtggtcaatgtggataaaacccggatcgttttcaatcaatcggatctgagccagtctgttaacgtcgtcaacagcggcggaaacgaaacgtatttgcaaatctggacagatgacggtgacctgactctctcacccgacgccagcatcacgcccgtcatagtcataccgccggtggtaaaaatgtatccgggagaaatgcgatcgttgcgtctggtactcacttcacgtcaggcgctgcccgcggacaaagagagcctctactggttaaatatttatcagatccctgcgctgaaaaaagagcttaacgcggctgaacgtaaagtggtgttaccgctgcgaatccggctaaaaatctttatacggcctgagggactaaacgccccgctgaccaacgatccggaaaagctccgtttcgcggtaaagggaaataaaatcgccataaccaaccctactccctggttcatgagcatgaatgtctattctgaaggtcagccatcaataaaaaatctcactcttgccccacaatctgatgcttacattgacagtcacactccgcctaaatccggtgagtcagtgagttatgcggtgatcaatgaccaggggattccggttaactacacgacaaccttgaagtaaccggacgggagtgccatctgccgacaggcatagtgcacataaatctgaccttttgcggcagtccagggcgtcgctacatgaattctgcgcatctgatggggctggcagtacgcagaatttacctacgcatggcgttttgagaggctcaagaggcagttccgcaagacaatccattttagccgcgctagagttgctggcttccactgtttcaacgacgagaaaaaatgaaacgcttatttgtctatggcacgctctgtccgggccgcgagaatgcccatatcctggaaaatattggcggagaatggctggccggttctgtgaacggtatcttctatcagcgcggctggggcgcagcggctgattttccgggcatcgttctggatgagcatgggcccgacgtgccgggttatctgtttctctccgaccagctggacgcccactggccgatgctggatgcgtttgaagatggctacgatcgcgtcgaggttcgcgtttctgccgaagataatcggcaatacagtgcgtggatttatcagcttcagccgcaggaaagccgctgagctatttccgctgaacttttcctgcatcaaccctgctttcctgcattgggatgcgcgcgccctgctcttattgtctgctgaccttattttcctgtcagacaatatatacgggcacgttgcctgattctcaatttaattaagatctaatgtatgatgtaactaaaataagattgtccgctctggtcccggcaagcgctctcttagccccaccagccagccctgttataccgggttaatctggccagcgctgatgtggaaacagtgatacccgaatattaaacagatggattaagggcgcaacagccacactctcctctcgggcgatcggctccagtcttagcagcaacagatccagctcttccagcagatcctgatgtggcgctaactgcagcgatttcatcttgcgcttcaggtatagcgccagctcgtgaaacatctgaccactatcaatctgatgactctccagcacctcacgataacgtgcgtagaagtcataacagttggcgcccagccaggtttcagtaatcagatagccccccaccacgatatccggcaccggatcgagccttttacgcggcagaatgatattcacccggtcgagcatccgcgcaataaattgctgccgtgacagtagcgtggcggaattgcgctccaccattttaataaaccctaacagatcgcgcagccctcgttgcaccgctcttctggctatccatgacggccgtttgttgcggatcaacgccgtcagcactaccgcaaacataatccccaccatcgaggagatggccgcattcagcgtgacgatcagattcgggacatagtgatggcttaagccgataaaaccggggatctggatggcgacactcagccctaccagattggtcgccggattggcaatcaccaggctcagcagcatcagaccgggcagcagtatgatcatcagcgcctgtaaggtattggcctgcgggatcagaaaagcgatgtagaacaggctgaccaccagcgcaatcatcacccctttcacgaacagcttcatcggcgttaccggggaatcgacaccagcaaaaaatgaactgataatcgccgccattagaggtgcattcgccccatcggcccagccgctgccgatccagaacaggctggagaggaaggtcgccagaaatgccgtcagcgcggacagccgtaacagtcccttatcgatatgccggtgttcccggatattgcggatcgccgccccatccccgtggctgtagagatcccctgcgcgcgcactgacattctcataagcatcggcaatgcgcacaaagttagccagccgctcaagcagaccaatcagcagcaggctctcttcggttgccagcagcccggcccgccattcgtgctccagggttgcctgactggcagcaatcgcttcacgcagtccggcaatatcgttaatccgatcgtggtgcagccacaacaggaactgctgaaacacgtcggtgacgcacggcggaaaacgaatattgagttcggccagcacacccagccgtgactcaatcgccgtcagtgtcggcagcagataagtcagatgctgatactgtacgctgaccagacggatgacattacgcgccgcttcgccctcatagacgcagtgggtcagcagcgtttcaacattcaacggataacccgccatctgaatcaggatatcttcgcgctccagcgatttgttctttgccattccgctgatcagttcatcacagagtttgcgcgcgttctgaaaccagagattaacgctctgccccagcagatgatgcatcgaaaccggaaacaccagccggtgaaccagcgtgctgcaaaggatgcccagcgtaatctcctcaatacgtgaaactacggtgttgatgattgccaacggtgactccacgtcaggaaatcccataatcgctgcgctgtagccagccagcataaagatatagctcttcggcgtgcggtcatgcagagagagccagaggcaaaccgttacccatagcgatacgcacaggctgaacaacactggcgactgcaccgtttcggggtagatcagcagaataaagatgccgcccagcagcgtgcccagcaggcgaaacagcgatttcgagacggtcgatgctgcatagagttgcgaggtgacaaacaccgtggtcagcgcccaggcgggtttttcgaagttaagaacgagcgccacagagagtgcgataaacgcggcaaaggaggttttgcaggcaaacaaaaccgcgtttttggtaaaccatttcatcgaatgagagcaaccaggaactttctgaggcgcgtatcctgacagatgcgcctgcgttttactctcagttaaattttacaaattattaccggccgcatcaggccggttaagcccctgctggcgcaccagcgcacggcgcttatccagtaaaaaagggcgcagatagcctaccgtgttcgagagcaaaatcacctcttcggcaagctcaatcctcagcacatctgtcaggtacgctttgcgctgagtcattcgctgccagagatcgggaaaacgacgcgccagctcatcacgcaatgccgcgtccgccagtgcgaccgtatcctcgatactgcagccgccataacccggcaccgacgggataatatcgatctgcagcagcataccgcttttcagtgtcacggctgaatcgggatagatgggcgagcttagccactcctcgtcagccaccagatgccccggattaagatgccagccatactgcgctttcggcagcaccgtttcgataagcgaatagagttcgccgccggtgatcccgatccgcaactgctccagccagctgaccaccgcatgataataggggatcgccagcctggtcagccagtcggagacgttacactgtaactcagaggcttcactgaccacgtaagccgagcggctggtcagcccgcctttgtagccggtggtaagagaaagcttatcaccacgcgcaatccgtttatcagacggatagagccgggcctgggcgaaacgatcgctggtcgcggcaatcgtcaccaccgtgtttggctgcccttctgcgttcagacgtgcgcctaacgccttctctgtgacgcccggcgctatgctatccagcgcagccagcatcgcggttgaagcaagattagcccccgcctcataaaacgccacttcatcggcgccgttaacgcagcgtgcaccgttgtcaggcgagataaacaatccggtggcgtttaccagttgcgcatcgccgcccgctgcctgcgccgccgaggcatagatgaactgcggcagatcaaacatccctcgctccctgccggtaaataacttccagcccaccagcccggtgcgtttcgcctgctacaatccctgcctctgctaacagctgatccaggggctgctccccgcgcataggctggttgggcagagaaaagaccgccgcatgcagacagcgtcccggattgcgggcaaacggcaccagcttgaggttctcattacccatgatataggtgagctcgccctgctgagtcaccaccagcagcgcctcctcgaagcgcggaatgaatcccgccagatattcaaaattgctgccgtgctctttgtcggcatagataatcagttgcgcaatctgctgctgctgcatccgctcaataatggcggccagacggcgatgcagtgtttcatcagacatcacagggctggcagcaccgggaaatgccggcggtgacgggattgtttccagggcatagcgattggcatccataacgcactccagtggccagattgacggggtttgatttccattcccagggtaaacctgaggtttagcctgtagggtgccacaatcacacaacttactcgttgcgtgttatcaaaagagggacattcacctgtaacagagacaaagaagcccgcgctaaacgggctctctgtgttatttgatgggcacgcctgcattctccagcgcttcagccttttcgggatataactccgacgttccggcattcataatcaccgctccacagcggatgcagtgatcgccctttacatctggcacaacgtcctccggattacccgtattaagactgacatcgcgcgtggcgtacacaaacgcctctccttcacatcccggacacttcataccatgactctcctgttaagcctgtcagataagcatagccgacaggcttttagccatacacatgaggagaggtttttcaggatattgccagctcataagcgccatcactctttttgccgtagccgctccagcataatgagtgaatgactgaagatggcgtcggcgatgtgctgcgggaaatcgggcggcaaagcatcgcgcaccgagaccactgcctggggaaaggccttaataaagaagtcgaagatctgctgcaaactgtcacgatcaaaactgacgctttttgccgtggcgataaaatggcgcgggaagattttatcgatttctgtcttcttccccttagtggcacgcagacccatcgccagtttcagcgctcgcttgttcagaccggtgccgcccagtaccgggtaagcggagatcacatcataaaagggagtcagtcgataactgccaccgcgctcaataaacagtgagaagttcttggcgtgaccgtcagttgcgccaatcagccactgaaacacctggaacatcataaagcgatagcgatcttcgatggcgttgctcgatcccatcagtatctgcatgatctccacaatgcccggcccgccatccgactcatatttggttgaagatggcagtcccagcgcctgacagaaatcctcctgcggcaggcgaatcaaccgggttttatcgcgtgaccagcggcggtcgaaacgttctaccgccagggcgcgcatctgtccggcacgaataatcgttgcctgcggcacgtcgataccgagtgcacgggccagcgccagacagagatactcattctccacactttcacgcatatccagcgtcgcggccggctgtttaatctctccgatcggcagcttaatgatgtgcgaggtgggcgtggcaccggcaggaatgctccagccttcatcggtcagcagcagtgcggttttctcctgcgcccccgcgaccgagatacggaaatcggtctcttcacgcagcatccccagcgggatatctgactgataggccgacagcacgctttcgagccgggtttcatccagcacttcatagcgggcctgcagtgcgggcagtggcatatcgggcggcagcagcatagtcgccccgacgctgtcacgtcccacttcctgcaacagatcaaacggctgacaggatttaatctggtaacgcgccacgattctgtcgcgaatcaatgggctatccggcagcagattatcgaagaagttaatcacggcgtgtgaggtgagagccttaacctgcaacggcatcgaaagtgacagcggcctggagagcggattactcagccagccggtatcatactgaaactcatgagcgccgtttcgctgccgggtgagtacgcctacccgctcgccgttcatccacgcaatcagcctttgcattaccactcatcctcatcatgcagctgaggcgcaccggcctcctctttctcgtgaacttccagactcagctcaagcgactgtaacagcttaaacagcgttgccagcgaggtactgtcaggggcattttcaaagtgagagatggtggcctgtttcaggccgacctttttcgccagctcactctgggtccagccattgcgctgacgaatgagctttagccggtttgccagctgtagcgggctgtatatcatggggtggctccttctggatcacaggctgtaagcatagcgcaggggcattatccccgacagggtataaaacagcttttaccccctgtagaggataataattactttataccctataacggataatctcacaattatccttttcaggggataagccggaaccacaattaaaagaggacgaggatgagcacatttacccttacccatcaggacaacgacgacgatcgggaagagttgctggcaggactgggggcttacaaccggcaatttatcagccgcgataactggggaccgctgtcggtttctcacagggacgaacagggaacgttgcgcgggggagtgatcgccgcacgcaaaggaaactggctctgtatcgattatctctgggtggacgaaacgctccgtggcagtggtctgggcagcgcactgctggaagccgcagagcaggaggcgggaaagatgggatgtctctatgcgctggtggatacctttagttttcaggccctgccgttttatcagaaacagggttatcagccgcagatgtccctgcccgattttccgcaaaccggtatgcagcgtcactatctgaccaaaacgctacggccaaaggcatcacgctgaccgcagtaccatcagcgtgacagggtcacataattacaaaccggcaatgcgccgcagatccgcttcggctcccggtgccacggccagtacctgcgcgcctttagtgatgcgatcgccttcggtgttaaacgggtggtaccagccgcccgcctctttcaccaggcagtaacccgccaggcaatcccaggcatgcatatagggtttcgtagtaacccacgacccgaccggcggcaacccaggccagcatcagtgcgccggaaccaatacggataaagttaccgcctgccgacagcagcgctgccacaatctcgcctacctgctgagggctgacatagctgttggcaccaaaaccggtaacgtggttttgcagcgtgcgtgtgggatcgacctccagacgatgaccgttgagcgtcgcgccctgccccagtgccgccacgtagcactcctgataggtcggcgcgaaaatcaccccgatgacgggcacatcaccgcgcagcaccgcgacggaaacacaccagctcggcatcccattgagaaacgggctggtgccatcgatcggatcaaccacccaggtgtagtcagactctcctgcctgcaggcctgactcctcacccagaaagccatcatcgggaaacgcatcccgtatacggctggcgatcagctgctccacttcacggtcggcaatcgacaccacatcctgcaaatcgtacttggtctccaccaccagcgtctcgcgacggttgaagtaagataacgccgtcgcgccaccttcacgggcaacggcttccgctaaagccagacgcgccattatttcatcatgcgattccatgcgaactccttgagttagtcagattaacgggcaatcagggcaaggccctgcggcttaaagttgacgccaactgtggtggcgagcggcagacgctgttccatctgcggatcgataatgaacagcgcgcccagttcggtggcgacttcatattcgatatggtcgcccagccaggtgctgtgaatgatctccccctgcagcgccccctgaccgtcgcctgacaacgtaataaactgcggtcgcaccgccagctgagcactgccggtttttgcaccggcacctcgtacccggaagcgctgattacccaggcggaccagcgcgtcatccgcatccgcctcttccacttcacagggcagaatattcgcctcccccataaagtccgcgataaagaccgaattgggcgaatggtaaagcgtctccggcgcgccctgctgggcaatatccccctctttcatgacaataatcttatcggagaccgccagcgcctcctcctggtcatgggtcacataaaccgccgtaaacccgagccgctgctgcagatcgcggatgtcggtgcgcacccgacggcgcagacgctcatcaaggttcgacagcggctcatcaagcagcagcacctgcggttccagcaccagcgcgcgggcgaccgcaatacgctgctgctgtccgccagagagctccgacggcagccgctgcccctgactctccagacccaccagcttcagcccctcgcgcgccctgtcctgcgcctcgcgtttgttcatgcccgaggaaagcagcccgtagagaatattgtcgatggcgttcatatggggaaacagcgcgtaggactgaaacaccatcgccacgtcgcgctcgttggcgggcagatgggtgacatctttgccgccaatcagaatccgccctgcggtgggatgctccagcccggccagcagtcgcagcgtagtggtcttgccgcagccggacggcccgagcagcgtcaccagcgtacccggctctacggtgagcgacagatccggcacagcagtaaaaccggcaaaacgctttgcgacatgttcaaacaccaccgatccggcgttaagggtcgtcatacggctctctcctgagtcagagtggatgcagagggtgcggcaataatcaccgccggttggattgcacgacgcaggcgacgttcgcccaccagcagctggaaaaggccaatgatcagcagcatcaccactatcaataccgaggagtaggcaatcgccacgccatactcaccgtttctccaccagcccgacaatgtacgaggtcgccatgttgtactgggcgctgaccaggaaaatcaccgcgctgatagaggtaatggcccgcacaaaggcgtacaccagcgcggcgctgatggccggtttcagcagcggcagcaccactttacgcagggtgcggaaactgtttgcgcccagcgtcagtgaagcttcatccaggcttttatccagctggctcatcgccgcaataccaccacgcacgccgaccggcatattacggaagacaaagcaggcgatcaggatcatcgcggtaccggtgatctccagtggcggcaggttatacgccatcacatagctcacaccaatcaccgtgccgggaatggcaaagctcagcatcagcatgaactcaaaggtctgacgaccggcaaacttctgtcgcacaatcagccaggcggtcagcagtccgacaatggccgtgagcggcgcggcaatcagggcgatctccagcgtggtccagaaagagctccaggcgacgccgctccagaccagttgcccctgattaacgctgacgctaaaggcgcggatatagtgatccagcgtcaggttgttattcagcccccaggactgcacaaagccgccaatcatgatcatgccgtagatcaccagggtgaacagaccccagggtatcaccatgccatagacgctgtagcgcaccggacgcggcagcatcacatgacggccgccatcgcctttgccggtgacagtggcgaagcttttgccggagagccagacgcgctgcaccagaaaagcggccagggtgaagcccagcaggatcatcgccagcaccgccgcgcgactcgggtcgttctgtgcgccaaccacggagaagaagatctccgtcgacagcacgccgtgactgccgcccagcaccatcgggttaccgaaatcggccatgctttcgataaagctgattaagaaggcgttggccagccccggcgccatcagcggcagcgagatgcgggagaaagtgcgccagcggctggcacgcagggtctgtgacgcctcttccagtgacggactgacgccctcgaccaccccaatcagcaccagaaaggcgatgggggtaaaggagagtacctgggcaatccagatgccggtcatgccatagagccagcggcccggctcgatgccgaacagcgtcgccagcgattcggtgaccacgccagagcggccaaacagtaggatcagcgccagaccgatgacaaacggcggcgtgataatcggcagaatggtcagcatccgcagcgcttttttaaacggcagcgaggtgcgcgtcgccgccagtgcaaacgccagtcccagcagcgtagcgccactggccgtcatcagcgccagtcccagcgtgcgccaggcggtgccgcaggtgccaccggtaaaacagccgaggctccagatggcgggatcctgcatattggcaatcagtccgtcaggtttaaaactgccatcaatatcctgcaccgaggcgacaaacaggctcagcaccggatagagcacaaaggtcgtgaccagcgccaccagcagcacaatcgacgccaccacaaaggcatcgcctctcagcacgccgcgctccgccagggcaaaggcgaaaatcagcaaaaatatggtcagcagcagcagcgcacccgcacccatcgcgggttgtccctgcgccagcgggccggcgaggtttctccagccataaccagttccagccactgaaaccgatagcatgcccttccagcaccagaaacagaatgccgcaggtgctgaacagcaacagcagcgtgctgcgggtgcggcccgggggcagaaaggcgctgccagcacagagcagccacagcgccacggcgatgcccagccagctgtgtaacgcgagctgccccagcgcaggcgcattgttctcatcaccccataagctgaacagccagtcacccgagaagaagccctgctccaggctataccagggcagcagcgtcagcgcgatggcgcccgccagcagcgcgccggttaagcgacgattgtgcgcattcataaatcacctcgatcaggaagcggacatcaggcttacgccaccgcggtctggcacagacccggctcaggtggccggggcgcaccaccgttattgtgcgctggcaccaatctctttatcccagcggcccagcagcgctttgcgttttgctgagtcaccataggttttaaagtcataatcgatcagcctgatgttctcgaagcgcggtgcatattcagagatctccgccttgcggttagagggcagctggaacgatttcgcctctttcatatgcgactgtgctttagcgctgagcgcccagtcataccaggctttggcattggccaggtttcgtgcccctttgatgatcgacatcgaacctatttcatagccagtgccttcacagggcgcgacgggcttaatcgggaagccatctacttccatcgcgacggcatcatgcataaagacaatgccgatggtggtttcaccgcgcgcggcggctttgaccggagcagagccggacttggtatattgcgagatgttggcgttgagcttcttcaggtagtcaaaggctttgtcttcgcccatgatctgcaccagcgtcgccagggtgttataggccgtgccggaagagttgggattggcgatctgaatctcgcctttaaagccagggtcgagtaaatccgcccagcaggcaggcactttctgctttttctccgccagcagtctggtgttatagccccagcccagcgcaccggcataaacgcccacggtgcgataaccggagatctccgccactttttgtgaccagggctgttgctgatcgagcagtggcgatttataggcctgggtcagcccctcttcggcggcctgcatatgcggatcgccggtaccggcccaccagatatcggtacggggattgcgtgcctcgctgcggatacgggcataggcttcaccggcagagagccgcaccatgctgagtttaatatcgggatgggactggctgaacagcgtggtcatctgttcgcacaccaccacatcggctgagcagatcatattaagattgcccgccgccgaggcagcaaacggcactatagggcagacgattacagcagcgagcagagaggaataacgcatggtgttctcctgggctggatgacgcaggcgcgccagcttttgcacatgtgtgcaaacatatgtgcagattagtacggcggccctgctgcagtgtcaattcagttgttaagcaattgtcagtcgctgtcacaaatatgaaacctttcgcccatctgtattttttgcacagccttgcaacttcaggcaaactcagtgcagacaatgtcaggcgaggagagaacatgcagcagctaaaggcggtggtgagtgcgcaggatgtggctgaccgggcgggcgtctcccgctcagcagtctcccgcacctttacaccgggggccagcgtgtcagatgctacccgtcagcgggtgatgaaagcggcggaggaactgggctatcacgtcaatcatctggcgcgcggcctggtgcgcaaccgcagcggcatcgtctgcttaattgcctccgaggttgacacgccctaccgtgccagcctggtgcgctggatgacccagtatctgcaggaagcgggaaaagtggcgatgctgattaacactgaccgatccgatgcgcgcgtttccgccgcgctgcagcaggcgattaattttcgcgccgacgcatcgattattctctccggcatgccggacagcggtatcacccggctctgctacaaacatggtcagcatctggtgctgattaaccgcgacgaatccctgcccggcacgctcagtatcaacctcgactcccgccccgccgcagaaatggcggttaacgcgtttgtgcgggcgggatgcagccgcatcgcctttgtcaattcgctggcgggaacgccgagtctgctgaagcgcgaagcggattttctggccgccgcgcagaaagtgggcgtcacggtccaggtggagcggttcggcaccacctcgtacgaaagcggccagattctggcccagcgtctgctgacgcgtaaagttcgccctgatgcggtgtactgtgccaccgacctgctcgcctgcggctttatggatgaggcgcgtcaccgctttgcgctgcgtattccggacgatctctgcatcatcggacacgataatatcgcgcagtcgggctgggcctcttacaacctcacgacctttgcacagccggtggagcaattcgcccgcgatgccattgcctggctggtggagacggaagcgcaaccggagacgctgatgccaaaaaatgaacagcagcaggagcggagaatatatccggtagatgtggtctggcgcggttcggtacgcggcggttaaccgcccttttttattttcttccgctatgtaattacgtcctgaaataatccacaaccgatcttacgcttcgctttaaatatcccgcccctgcactgaaaaataatcggacgctactgcacagtgttccgattttctgtctacgctttatctgcattattaagttcttctggttttaactgctcaatgaatcagcagtcagatgtgacaaatatcacatttgtgccaggcttaatgtctcagataactctgttcaaggagcatacaatggctacaccaactaacaagacgctcgatctggatcaatttcctaaacctccttttgaggaccagccacaacaggcgccaggcctggccagtaaaatgatcccggttcccgaccacggtgaaaccagctatcgcggcacgggacgactgaccggccgcaaggcgctgatcacaggcggtgactccggtattggccgcgcggtggctatcgcttatgcccgtgaaggcgcagatgtggtgattaactacctgccggaagaacagcccgacgctgatgaagtgattaaattaatcgaagcggaaggccgtaaagtttttgctattccgggcgacattcgttctgaagaattctgtcagcaactggtcaaagaggcagccgataaattaggtggcctggatattctggttaataacgccggtcgtcagcaatttaatgagtccatccgtaccctgagtacggaagattttgacgcgacgtttaaaaccaacgtttatgcgatgttctggatcacaaaagcggcgctggaatatctgccacgcggtgcgtccattattaatacctcgtctgtacaggcgtttaaacccagcgatattctgctcgactatgcgcagaccaaagcggccatcgtcgcctttaccaaatccctggcgaagcagctgggtggtgacggtatccgggtcaacgccgttgcaccagggccgtactggaccgtgctgcagtccagcggcggacagccgatggagaaagtgaagcagtttggcgccgactccccgatgggccgtccgggccagccggttgagatcgccccactctacgttaccctggcctcaaccgagagcagttactcctccgggcaggtctggtgttctgatggcggcaccggtacgctgtaatctcactcaggtggccgcataatgcggccatttttttgtcccgcttttgccccgcttaagaaacctcgccaccgtgatataaggaagcagattatggaaaacccgatctttcattcgccggtcagaaaagagggctttgcgggcctgggtgattatgccgccattggtgaaggccgtttctgttgcgctgattgcgccggacggttccattgactggtggtgcgcgcccaatctcgacgcaaagcccctgtttgatcgcctgcttgatgccggactcggtggctacttccagattgtcccgcgtgcgccttatcaggtctcacgccgctaccgcgataacagcaacgtgctggagacccgcttcgaaacccgtgacggcaccgtgctgctgaccgaatcgattaacagcacgctggcgggccgtctgccctggtgcgaactggctcgccgcatagagggtgtcagcggtgaagtggaattagcgatcaccctgcgcttcggcaccgccgccgaaacccgttcaccgtgggtggccgataatgagaaaggcaaggtgtttcacatcgcggagatcatggcgatgttgcgcaccagcgaagatattcagatcacggagctggatgacgagcaggtctgcgccacgctgcgtacctatgccggttcccgctcgctctgcgcgctgctggtgaccgagaaagagccactggcggtgccgccgctggaggctatcgatcagcggattgaaaccagccacaccggctggaccagctgggtggagagcctgagttatgagggccgctacccgacgctggtgaagcgctcagccctgtcgctgaagtttctctggtactctccgaccggcgcactggctgctgctgccaccacctccctgccggaggggatcggcggcgaaaaaaattatgattaccgctacgcctgggtgcgcgatgcctgcctgattattaaagccttcgtctatctcggggcgctggaagattgtaaggcggccttttcctggctgtcgcagaccatcatgcgccatggcgtcaggctgcgcgcctgctatgccctgaatggtgatgaggtccccgctgaacgttatccgctgctgagcggttatcagaactctcagccggtgcgggtcggcaataatgcccgcgaccagctgcagctcagtatgtatggcgacatgctggtgacagcccagcattttatcgaggcgggacacgtgctggatatcaccacctcgcgcatgctgggcgagctggcgaactgctgcgccgatcactggcggcagaaggattgcggcatctgggagctgccggagctgcaacactacacccactccaaaatggcctgctggatggcgctggatcgggcggtggcgctggcagaaagccagcatatcgaaccgacctggctgggacgctggcagcgggaaacgtgaccgtatccgcgactggattgagtcgcactgctggtcagagcaacagcaggcttatctcttttacgccggcagtgacgatcgcctcgacgcgtcgctggcgctggttcacagctacggcaacgcggtcaatccgcagcggatgctctcgacctaccgtgctatccggcaaaaactgggtgacggcagcgccatgctctatcgctacagcggggtaagagaagaagagagtacctttctcgcctgcgccttctggctggtggaagcctgggcagagataggtgaggcggatgaggcagaacaggcgatgcaggagatcctgactacgctgaacggccacggtaacgtcgatatcttcaatgagatgtatgacgtccgcagccagagctggcgcggcaatatgccacaggggctgagtcatctggcgctgatctgcgcggcgcaggcgctatcggaatcgcaggcgcctgcgtgatgtgagatgttgcggtgagaaaagtggcgaatccggcgccctattgcagcctgaaacgcggatcgaagaaaaatggctctaccaccaccttactgatgatgccagccgctgccggatgacggggattgaacagcgcattccactcgccggtcagcgtgctcggtaccttcagcaccaggccgttatccgggctggcaagccagtcgtcaccaatttgccgcgtggacgatggcgcaggatcggcctgccagtcatcggggagtgccgccagcgagagctcggtaatcagcgattcagggacgctaatcgacagcattgagtagtcgtgtgacagatcctgaatggtgagatgaaccagcgcctcaagtacacagagcgcccggcttgatcccatatagacacagaccgttcccacggaattccagcgccccccgtaagtgcgggcaccaaaaccatcaaaggcgctcatcgcatactcactcttcaccaggcgaaagaaacgtactgccatcaggtaatcacgccatgctcaagctggccaatcaggttaatcaccgcttctgcacccgccaccgtggtggtcatctccgccggtttcttaccgcccagcgctttggcgggcgtttccagccactgcaccagacgctgcctgtcgtcgcggaacagtttgctggcggcagagaggacgcggatcagcatgtagatccgtccgctctgatcgggcgaaaaggtctgctgcggatctttgactttgcggttgtaggtggtgcgatcaatgcccgccagacggcacagccagccctcgtcaaaggtggacaacgacgccgtgcgtttcagcacgccgctgctgaaccctaccgcaatacgctggtgcgcatcaggcagtgtttccggcagattcagggcatgcagcagcgaattgtcgcgacgatgctgagcgggtgtgtagatggcgatagacatagcagcctcctgttcatttgatttttattttagcgcaaatgaacaggcggtgccagctttaccccgtcgctgagcaagcgtgatgcctgttactcaggcttctcctgctgtaacgcctgcagaatctgccacgccgcctttatacgcagcggattagggtaattcttgttggcgagtatcacgatgccgctgttcctctcaggaataaaggcgatataggcaccaaatccattggttgtaccggttttatgcacccagctggcgctctgcgacggcccgaccggattgagcagcgttgccgggcggggttgcagcgcaacaccattatcgctgtcacccatcagcgtgtcggcagtcaccggccagtcgtagatctcccagcccagtccctgaaacaaggtgccgactttgaagtagcgcgcctgcgcggtgcgaatggcattacgcagcacggcattccccgaagagaggcggttaggatccacatttgcctgcataaaggtgagcatgtcacgcgcggtggatttaacgccgtaggcttctgcatccagcatgccgggtgagacccgtaccggctggccatttttatagccccaggcgtagtccagcatcatcgagggcggcacggtgatataggtgcgcgtcagacgcagtggctgaaacacatttcgcgccatcgcctgctcataatcccctttcaccatcagcgaaccaaacagaccgatgctggcgttagagtactgccggagcgtgccgggcgctgcctctggctgccattcctgatagaaacgcagcagcgaagcctgatcggtgacgtcatccggcaactgtaaaggcaggccgcccgcggtataggtcgccagatgcagcatccgcaccggacgccactgctcaccggtcagctgcggccagtacttttgcaccggatcgttaaggcgtatttcgccgttgcggatcatgacgccagccagggtgccggtaaaggttttgctcacggagcccagctcaaacagcgtgttttccgtgacccggcggcgtgattcgagatcggccacgccgaagttcacaaactgcgcccggcctttgtaaagcaccgccaccgacatgccggggatctcctgctgctccatcagcggttcgatcgcggctttaaccagagaagtaacctgctgtgaagagagatcggcggcgacacagctggcagaaagagagaataacaagagataaaacaaagactttttcattggcaactaagggattcttcactgaattaaattatttacactggtcggcacaggcctgcacgcacatctgagcctgagaactgcagccaccgttgtcccgggtgttgcagtgcgattgttctgtgtagcagttggtctgacaggcggagacatcgcagcgggcagcgacgggcgtcagctgtgccaggggcgcgcgggccggaaaaagcggtgcgggctgagcgaaggcgctgctgcccagtaatccggacagcagcaggctgatgatcattttcataagagttctccagagggacgctgcactaagtatggccagtctggcgcgccccgtcagagaaatctaatcaaattgagactacagggggatgttgagtgacattaatcacgccacggctgtagatatcgttgagccgggcaatgtaacgctgggtgtcatgctgatctttgatgcgcagaatcgccgcctcacctttctcctgcagcatctcaggacggtcgataatggcgagcagtatcgatttcagcccctccaccagcgactggcgtagctgcgttttctgctctggcgaggtaatactgtattcacggtcagcgttaagcggactcgcaatcacccagcctgcgctggcaggattaatctctggcaacgcgcgcacgttgctggtgatcaccgggcagccgttagcctgcatctccagtaccgagaaaccgtacgtctcctgccaggttggtagcagtccggcatcgctctggcggaacagctgcatcagggcgccgttatccatctgtgaatgatgcgtgaagcagcgatagcgtttgatgcggttctcaatgccactatagaaggtctcatcatcctggaaactggcggtgcgccacgttacgacgcttggcgagatcgccaatcagctgcacatccagctgcgactcttccagtttgcgctcttcaatcagctcactgatcgccagcacgacttcagccccgcctttgcggtagaactcgttaccggcaaaggtcagtttcagaataccgggctgacgcggcgttttctgctgtacaaacagcttctgcggcggatgcagcaccagggttttacggcggatttgctgggcaatatccggcctgaacagtttcatctgaatgttcagggtggcatctgagatggcaatcaaccccaggcagttatcttttaacagataaggaatgaggcgtttcagctcggggttgtcctgcttggcgacgcccgccaccggcagcacacgcggcagctccgtttcaaacgacgcgacccacttctgaggggttatcgcaacttcattgaacagatgcaggatgtcagcccgcgatgcccctgaaaaaggcacaggctgaaagacaaaggttttattttttttgagcaatcgggttcgtagcgggttaataaagtagaacagattgctctttttcagattgatatattcgttatccggattaactaagatattacgctgctccggatactggttattcgtgattccaattttcatgttcgccttccagagtccttgtgtccggagtgatctatatcacgtgaacgtgactggcgggtctgagcaatatcctaaaagcccgtaatgacacggcctgaacgcttttgctaatgattgcgcacggtgctaaaacagtcacaattgtgtctggttatgaatttgcattttttattaacaggtgtgtttaactgtgtcaggctaaccccttattgaatatggcgattattttccgggaaatattcgcgccagttgttatgtaaatgtttaattaattgtcaggaatattagcgaagcggatgaggattttagttaataacttttaaagtaataagaatgaccatgctgaaaagtacctggcgcgttccactggctgatgattaacacaaacacagacgggcgataatgaaacaaatgatgcagcacggttatatccgcaccctttttgcacgcctgtttgccacaattcagtgcaacagtttaagaggatggcgggtgccatgcgcctcacatcattcattaagcctatgatttacatcattatttaaatgaggcgccctacaaccccctttctggtacaaaagttgcaggaagtgacgtatgcagacaggagagcattatgaaagcaatcgtgattggtggcggtataggcggcatgagtagtgccattgcgctggagaaatccggaattgacgttgaggtctttgaagccgtaaaggagatgaagcccgtcggcgcggcgatttccatctggcccaacggtgttaaatgcctgaatgcgctgggcatgaaaaccgcgctgcgtgagctgggcgggaacatggcctatatggcctatcacgatggcaccaccggcgcccccctgacccgcttcagtatggcgccgctggtgcagcaggttggcgaatatccctgtccggtggcgcgggcagaactgcaggcgatgctgattgataccttcgggcgtgaacgggtgcagtttggtaagcgggtgatccaggtcgagcagaccggtagtggcgtgattgccaccttttccgacaacactcaggccaccggcgatttcctgattgccgccgatggcacccattcggtgatccgcgagtatgtgctggagcagaagctggaacgacgttacgccggttacgttaactggaatggcctggtcaccattgatgagaagattgcgcccgccgatcagtggaccacctttgtcggtgacggcaagcgggtgtcgctgatgccggtcagcggcaatcgattctacttcttctttgatgtgccgctgccgaagggactgccgcaggatcgcagtacggtgaaagcggacttaaccggctattttcagggctgggcggagccggtacagcagctgatcgcggcaatcaatcctgacaccaccaatcgggttgagattcacgacatcgaacctttcagccgctttgttaaaggacgtgtggccctgctgggcgatgctgcccacagcaccacgcccgatatcggccagggcggctgcgcggcgatggaggatgccgtggtactggcctcaacgctggcttctcattcactgggtattgaagatgcactgctgcgctatcaggcgcgacgggttgaacgagtaaaagatctggtgctgaaagcgcgcaaacgctgtgacgtcacccatgcgcgcgatccggcaatcacggcagaatggtatgactctctgaaaagcgaaaccggtgaacgagtgctggccggaatgtgcgaaaccattgaaggtggcccgctgggttaacactaataaaaccgggctgtcagcgcgaccagcgcgtgacagcccgttctgctatgactccgccagaccacgatttttcagcatgggctccagctgcggaggcccgccccgccagctttcatacagtgttttgagatcgctgctgttcccccgggacagaattttctgtcggaagaggtcgccgttctcacgcgtcagtccgccctgttccgcaaaccactgatagccatcgtcggcgagcatctgcgtccagatataggcgtaataacctgcagcatagccaccgccccagatgtgctggaaatagctggaacgatagcgcggcggcaccgccgtcagcgccagattatcgctctgtaacgcctgctgctcgaatccctccacgctttgcggcgcggaatcacggttaaggctgtgccagtgcagatccagcagcgcggcagccagcagctcgctcatctcgtagcctttgttgaacgtggcggcccggacgattttttcatgcagctcagcgggcatcagcgcctgagtctgatagtggcgagcgtagttgcggaacaccgctggctcgctggcccagtgctcgttgatctgcgaaggaaactcaacgaaatcgcgcggggtttccgttcccgacaggctcggatagcgctggctggcaaacagaccgtgcagcgtgtgaccgaactcgtgaaacatcgtgataacgtcgtcccagctcagcagcgccggttcaccggctggcggtttggtgtagttacagacgttgtagatcaccggtttgctgtcgagcagcgtagactggttgacgaagttgctcatccaggcgccgccgcctttgctgtcgcgcttaaagaagtcggtgtaaaacagcgccagcggggtctcatcggcgtcaaaaatctcatagacctggacgtcgggatggtaaaccggcagatcctgtcgcggcgtgaaacggatgccatagagctgcgtcgccgcccagaaacacgccattctgcaacaccgaattcagttcaaagtagggcttaatctggctctcatccagatcgtaacgggcacgccgcacctgttcggcataaaaacgccagtcccaggcctgcagggtaaaatcgccctgctgctgatcgatagtctgctggatagccgccgcttcacgctccgcacgaccgcgcgcggcaggcacgatgttatgcataaacgccagcgccgccttaggcgttttggccatctgatcctgtaacttccactcggcatagctggcaaatcccagcagccgcgcctgctcggccctgacctgcgccagacgtaataccagctcgcgggtgtcgttctcatcgcctttttcagtgcgcgtcacgcccgccttaaacagcgcttcacgggttgcgcgatcggccaggctctgtagcgcgggttgctgggtggtgttttgcagcaccagcagccagcgcttttccagtccgcgtgcctgcgcttccgcctgcgccaccgccagatcggccggtgagagtcccgccagcttctgcagatcatcgacgaccagcccgcccgctttagtggcggccagcaatttgttggtgaagcgggtaccgaggcgggccgcttcctgattcagtgtcttgagctgctgtttctgcgcttccggcagattggctcccgccagctggaaacgctgccagatcacctcgaccagccgttttgattcggcatccagtttagcgcgctgcagatagaccgcatcgagccgcgaaaacagcgggcgattaagcatgatgtcatcgttgagcgcggtgagctgaggcgcaatctcctcatccacctgctgcagatacgggctggtatgcgccgaggtcatggcactgaacaccagattcacccggttgagcagttgtccgctcctctccagcgcctcataagtgttgaaaaagctgggcgcgtcgctgttcagtgcgatcgcctcgatctcctgacgcttctcctcaatgcccgcctgcagcgcgggcagaaaatcctgctcctcaatctggtcaaaaggaggagtctggtaaggcagtgtgctgacgctaaagaagggattctgacgggcgttcatggttcgctcctggtgggcatcgcaaagtcttatcctgacaggttgccgcgcaggcgacaactcaggcgacgtgctgctgataaacgctgatgatttcaccggcaatcgccaccgcaatctcggcgggcagcttgcctttgacgtccggcaggccaatcggacagcgcaggcgcgccagcgcttcgctcgcgacgcccttgcccgccagcctgtagcggaaacgctggtttttcgtttcagaaccgatcaccccggcatagcggaaatcgccgcgcttcagcaccgcctcgcacagttcaaagtcgaggggatgatgatgggtcatgatgatgaagtagctgcctgcgggtgcctgtgctacgcagtcgagcggatcgtccggctgcagcgtcaccacgccagcgggaacgtggctgaactgcgccggacggctatcgatccagtttatgtgacagggtaacgttgacagcagattgaccagggcctgtcccacatggcctgcgccaaaaaggtagatctctggctgcgcctgcagcagcggctcaaacagcagcgtggttttgccgccacagcactggccaagccgagcgcccaggctgaaatcctcggtgtgtggcgcagtcgccccactctgcaacatcgccctggcctgggcgatgcactcaaactccagatgaccgccaccgatggtgagataactctcctgctgcgtcaccaccattttgctgccactgtcgcgcggcaccgaaccgtgctcactgagcacggtgattaatacgcagctctgacgtttttcacgcagctgatgcagcacgccaatccagtcatgataaatcatcaacccctcccgtcaggcgttgcacgccccagaagatgcgctccggcgtggcgggcgcatccagcagtgggtgctgccggtaatcggagacgctggcgaccgcatcctgcagggcacaccaggcggcgatgcccagcataaacggcggttcacctacggccttggagtggaacaccgtgtctttagggtttttacggttctccaccagcgtgacccgcaggtccgccggaacgtcgctgatggcgggaattttgtagctcgccggtccatcggtcagcagctggcctttatcactccacaccagctcttcgcaggtaagccagccgacgccctgaataaagccaccttcaacctggccgatgtcgatggccggattcagcgacgccccgacgtcatgcagaatgtcggcgcgcagcaggcgggattcgccggttaaggtatcaatcaccacttcacagcaggctgcaccgtaagcgtagtaatagaaacggcgtcccgcgacccgcgacccggtcgtaatgaatccccggcacgcggtagtagccggtggcggagagcggcacctgattcagccacgccagcttcgccacctcggcgaaggtgtaatgtttatctccggcgcgcactaccccgttgcggaagctcaccgccgccgcgtcgcactggtgtagctcgcagagcatggcggtcatgcggtcgcgcaggatctctgcaccattctgcgccgctttgccattgaggtcagccccgctggaggccgcggttggcgaggtgttgggcactttgccggtgtcggtggcggtgatctgaattttatcgatctcaatctgcagcacttcggcgacaatctgaatcaccttggtgttcaggccctggcccatctcggtgccgccgtggttaagctgcaccgtgccgtcggtgtagatcagaatcagcgcccccgcctgattgagaaagctggaggtaaaggagatgccgaattttaccggcgtcagcgccagaccgcgtttcagcagcggactgcgggcattaaacgccttaatctccgcgcggcgagcctgatagtcgctgctctgctccagctgttcggtaatctcatccagcagattatcctctacctgctggtggtaatgggtgatgttgcgatcctgcttgccatagtagttacgcttgcgcagcgccagcggatccagcccgcgctcacgggcgatatgatccatgatctgttcaatcgccaccatgccctgtggcccgccaaaaccccgataggcggtgttcgaggcggtgttcgtgcggcagcgatagccggttacccgtgcatccccgaggtaataggcgttatcggcgtggaacatggcgcgatcgacaatcgatccgctaagatccagcgaataaccgcagtttccggccagatcgattttgatgccgcacagacgcccatcctcttcaacacccgcttcgtagcgcacaaagaacggatggcgtttgccggtgacgcgcatatcgtcgcgacgtgaaagccgcatcttcgccgcccggccggtctggcgcgccacgatggcacagagacaggcgacaccggccgcctgcgtctctttaccaccaaagccaccgcccatccggcgcatatctatcgtcacctgattcaggctgatgcccatcacttccgccaccagtttctgcacttcggtggggttctgggttgaggagaagacctgcaactgctgatcttcaccgggaataaccattgccgtctgggtttccagatagaaatgctcctggccgccaatgtgaaacgccccactgacccgatgcggcgcacgcgccagggccgcttccacatcaccgcgctggtgaatgtgaggttcctgcacaaagctgccctgagccagcgcctgttccacatccagcagcggttccagcacctcatattcaattaccgcagcggccgcgccaaggcgggcagcctcgggggaatccgccgccaccgcgatcacgatctgtcccagatactccactttgtcatgggccagcagcgggtcgcccggctccagcggcccgacatcattgatgcccggcacatcctgccaggtcaggacgctgacgacgccgggaaacggcataacagggctgcacatcaatatgcaggatgcgcgcatgagcatactcactcaggcgcggacagagatgcagcagacccggcagctctggcttgtcatcgataaaacgcgcctcgccggagacatgtttttccgcgctctcatggcggttactgcgaccaacgccgctctgtaaatcagcggcatactgcgccttaatgacctcttcgttgagttcaggacggttatgagacatagcgggccacctcaatacaggttatttcgccgttgtggcgatgccagtagcggcgcagcaggttgcgtgcgacctgcagacggtagtcactgctggcgcggaaatcggagagcggctggaaatcctctgccagcgccgcggctgcgcgtgacaccgtcacggcattcagtggctgaccgatgaatgcctgttcacagtgacgggcacgctgcggtgtggccgccatgccgccaaaggcgatgcgggcactactgactacgccctgttcaatctgcagattaaaagcggcgaacacggcggagatatcatcgtccagccgtttggacactttccaggccacaaaatcaggtgacaccgtcactttatcgatgcgaatggcgcgaataaactcccctttttcgagccgggtctggcgatagccggtaaagaactgatccagcggcaggctgcgctgctgctcaccgcgctgtaacaacaggctggcgtttaaggccagcagcgccggcgaggcgtcgccaatgggggaagcgttaccgatgttgccgcctaatgtgccctgcagacggatttgcagcgaggcaaagcgttgcagcatctcgctgacgccgggaatgcggctggcaagaaattcgctgacctgctgcagcgaagcccctgcgcccagcaggtagtgatcatcaaattcgctgcagactttgagcgcggcaacctgctccagcgcaatcagcaacggtattcttttatgctgctgggtaatctgcaggctgagatcggtgccaccggcaatcagcctcgcctcgggatgtgccagatagatcgccgccagctgagccggagttttgggcaggaagcaacggcggccctcaccccctaattcctgcatctccggggttgccagcgcctcaagccgctgcacggttgcggcggcaccttgatcgaactggtctgtcaccggctgcgagcagagctgttcggcggcggccataatcggccggtaaccggtacagcggcagaggttgcccgccagcgcagtttccgcctgatggcgatcccagcccgaagcggttttttgcaggctgaacagcgacatcacaaagcccggcgtgcagaatccgcattgcgagccgtgacagtcgaccatcgcctgctgcgccggatgcagtgcgcggccgtgacgcagatcctcaaccgtaatcagctgcttgccctgtaacgcggagaccagcgtcaggcagctgttgaccgtttcatactgcattgttcccccgacggctttgcccagggttacgctgcaggcgccacagtcgccagatgcacagccctctttggtgccagggcgttgctgacgggtgcgcaggtagttgagtaccgtgaggttggggtcgagcgcgtcctcgctgaccagctggttatttaacagaaactggatcatgcggcttgctcctgtgcgtcgcgctgccagaccggacgaccggctacccaggtctgggcaatattgcggtcgtcgccgagcgtcattaatacaaacagtttttcccagatatctttgctgttgccgatgcgcagttgctgcagggcagaaaccgccgggtccagcaccacaaagtccgcttctttaccgatgttgaaatttccgatggcgtggtcgagatccagcgcgcgcgccccgcccagcgtggcgtgataaaaggcttcggccgcgctgagccggtagtgctgcagctggcccaccttgtaggcttcgcccagggtctgcagcatattaaaggtggtgcccgccccaacatcggtgccgatccccactttcaccccctgctgccagctgcgtttcaggttgaacaggccgctgccgagaaacaggtttgaggtgggacagaaagcaatggatgaatcggtatcgtgcagacactgccattcgttctcttccagatgcagacagtgagcaaagacgctgcggcggccggtcagctggtgatgatgataaacatccagatagccttcacgctccgggaacagttctttgacccaggcgacctcctgcgggttttcgctgagatgggtatgcagccaggtatccgggaactcctgacgcagctgctgcactttttccagcagctgtggggatgaggtcggcgcaaagcgcggcgtcagggcgtagctcaggcgtccgcgctggtgccagcgctcaatcagcgcccgggtctgctggtagctctgttcaggggtttcgatcaggttgtcgggcgcattgcgatccatcatcactttcccggcaatcagccgcatgttcagcgcttcggcggcgctgaacagcgcctccaccgattgcggatggacggtgccaaacaccagcgcgctggtggtgccgttggaaagcagctgatgcaggaagaaggcggacatccgcgcagcatgatcgggacagtgatactgcgcttcaaccgggaaggtgtagtgattcagccactccagtagctgttcgccaaatgcgccaatcatctctgtctgcggatagtgaatgtgggtatcgacaaagcccggcacgatcagtctgccgcgcaggtcgatgaccggatgccccgccagcatcgcctcgctattctcccagctatccagccccactacgcatccatcacgcagcagcagcaccgcatcctcaagatagcgggcctggccggccaggtcgtcgggacgatccaccacgccggtaaagtcaaagaagctggcgcgtatcgccgtgtcggttgctgaaagcatgggtagtcctttctgaaagcgcgatgttatatctgcagatgattatctgaataatcctgtgcaacctgcgtgccagaattgaaatagaataaattctttaaatatcagtcaaataagttaaaagaggaaagttgcgcaacaaataaggactgagatggcttagcaaccgtttgcggaacggatgcaaacggttgctactcaatattgcgcgccctgaacattttgagtatggcgggttacccgcaaacctgccctttaacggtgcaatctgccctgaaaaggcgcagctggctacccgttaaaatccgtttacaggtcaggcagtttttccacgcgcagaagcggaaatgaaatgctatggtgaagccatcgactctgaaaatggcataaggaacagtgagatgattatttttgtcaccggtgcgaccgccggttttggtcaaagcatcacccgtcgctttattgagaatggtcataaagtgattgccactggacgacgggctgaacg

(The sequence listing continues in the following parts.)

The invention claimed is:

1. A method for treating fire blight or other phytopathogenic *Erwinia* species in plants, the method comprising contacting the plant with a biopesticide comprising as an active ingredient intact or vegetative cells of a *Pantoea agglomerans* strain comprising a genomic sequence set forth in SEQ ID NO: 14 and plasmid sequences set forth in SEQ ID NOs: 15 to 18, wherein the intact or vegetative cells are formulated with glycerol and/or an agriculturally-suitable salt as a preservative.

2. The method of claim 1, wherein the biopesticide comprises phenazine produced by said *Pantoea agglomerans* strain.

3. The method of claim 1, wherein the biopesticide comprises D-alanylgriseoluteic acid (AGA) produced by said *Pantoea agglomerans* strain.

4. The method of claim 1, wherein the *Pantoea agglomerans* strain expresses the transmembrane protein EhpJ.

5. The method of claim 1, wherein the biopesticide comprises an agriculturally acceptable excipient, additive, and/or a further preservative.

6. The method of claim 1, wherein the biopesticide is formulated as a liquid, concentrate, powder, tablet, gel, pellets, granules, or any combination thereof.

7. The method of claim 1, wherein the agriculturally-suitable salt is NaCl.

8. The method of claim 7, wherein the NaCl is present in said biopesticide in a concentration of about 4% w/w.

9. The method of claim 1, wherein the glycerol is present in said biopesticide in a concentration of about 0.5% w/w.

10. The method of claim 1, wherein the biopesticide completely kills *E. amylovora* strain S435, streptomycin-resistant *E. amylovora* strain S153, and/or streptomycin-resistant *E. amylovora* strain S1605, when co-cultivated together in vitro.

11. A method for treating fire blight or other phytopathogenic *Erwinia* species in plants, the method comprising contacting the plant with a biopesticide comprising: intact or vegetative cells of a *Pantoea agglomerans* strain comprising a genomic sequence set forth in SEQ ID NO: 14 and plasmid sequences set forth in SEQ ID NOs: 15 to 18, as an active ingredient; about 0.5% glycerol w/w; and about 4% NaCl, wherein the biopesticide completely kills *E. amylovora* strain S435, streptomycin-resistant *E. amylovora* strain S153, and/or streptomycin-resistant *E. amylovora* strain S1605, when co-cultivated together in vitro.

* * * * *